(12) United States Patent
Petrie et al.

(10) Patent No.: US 9,127,288 B2
(45) Date of Patent: Sep. 8, 2015

(54) METHODS OF PRODUCING LIPIDS

(75) Inventors: James Robertson Petrie, Bywong (AU); Thomas Vanhercke, O'Connor (AU); Pushkar Shrestha, Dunlop (AU); Oing Liu, Giralang (AU); Surinder Pal Singh, Downer (AU)

(73) Assignee: COMMONWEALTH SCIENTIFIC AND INDUSTRIAL RESEARCH ORGANISATION, Campbell (AU)

( * ) Notice: Subject to any disclaimer, the term of this patent is extended or adjusted under 35 U.S.C. 154(b) by 975 days.

(21) Appl. No.: 13/171,032

(22) Filed: Jun. 28, 2011

(65) Prior Publication Data

US 2011/0314725 A1    Dec. 29, 2011

Related U.S. Application Data

(60) Provisional application No. 61/399,286, filed on Jul. 9, 2010, provisional application No. 61/485,349, filed on May 12, 2011.

(51) Int. Cl.
| | | |
|---|---|---|
| *C12N 15/82* | (2006.01) | |
| *C12N 9/10* | (2006.01) | |
| *C12N 5/14* | (2006.01) | |
| *A23K 1/00* | (2006.01) | |
| *C11C 3/00* | (2006.01) | |
| *C10L 1/02* | (2006.01) | |

(52) U.S. Cl.
CPC ............ *C12N 15/8247* (2013.01); *A23K 1/007* (2013.01); *C11C 3/003* (2013.01); *C12N 5/14* (2013.01); *C12N 9/1025* (2013.01); *C12N 9/1029* (2013.01); *C10L 1/026* (2013.01); *Y02E 50/13* (2013.01)

(58) Field of Classification Search
None
See application file for complete search history.

(56) References Cited

U.S. PATENT DOCUMENTS

| | | | |
|---|---|---|---|
| 4,948,811 A | 8/1990 | Spinner et al. | |
| 5,500,361 A | 3/1996 | Kinney et al. | |
| 6,100,077 A | 8/2000 | Sturley et al. | |
| 6,344,548 B1 | 2/2002 | Farese et al. | |
| 6,432,684 B1 | 8/2002 | Mukerji et al. | |
| 7,045,326 B2 | 5/2006 | Cases et al. | |
| 7,109,392 B1 | 9/2006 | Broglie et al. | |
| 7,135,617 B2 | 11/2006 | Lardizabal et al. | |
| 7,417,176 B2 | 8/2008 | Lardizabal et al. | |
| 7,589,253 B2 | 9/2009 | Green et al. | |
| 7,741,532 B2 | 6/2010 | Lardizabal et al. | |
| 7,807,849 B2 | 10/2010 | Singh et al. | |
| 7,834,248 B2 | 11/2010 | Green et al. | |
| 7,834,250 B2 | 11/2010 | Singh et al. | |
| 7,932,438 B2 | 4/2011 | Singh et al. | |
| 8,530,724 B2 | 9/2013 | Whitelaw et al. | |
| 8,535,917 B2 | 9/2013 | Singh et al. | |
| 8,575,377 B2 | 11/2013 | Singh et al. | |
| 8,716,555 B2 | 5/2014 | Liu et al. | |
| 8,735,111 B2 | 5/2014 | Vanhercke et al. | |
| 8,778,644 B2 | 7/2014 | Singh et al. | |
| 8,809,026 B2 | 8/2014 | Vanhercke et al. | |
| 8,809,559 B2 | 8/2014 | Petrie et al. | |
| 8,816,106 B2 | 8/2014 | Damcevski et al. | |
| 8,853,432 B2 | 10/2014 | Singh et al. | |
| 8,921,652 B2 | 12/2014 | Liu et al. | |
| 2002/0104124 A1 | 8/2002 | Green | |
| 2004/0221335 A1 | 11/2004 | Shewmaker et al. | |
| 2005/0106697 A1* | 5/2005 | Cases et al. | ............ 435/193 |
| 2005/0262588 A1 | 11/2005 | Dehesh et al. | |
| 2006/0053512 A1 | 3/2006 | Bao et al. | |
| 2006/0094088 A1 | 5/2006 | Picataggio et al. | |
| 2006/0206963 A1 | 9/2006 | Voelker et al. | |
| 2008/0268539 A1 | 10/2008 | Singh et al. | |
| 2008/0289248 A1* | 11/2008 | Gao | ............................ 44/308 |
| 2009/0061492 A1 | 3/2009 | Benning et al. | |
| 2009/0308041 A1 | 12/2009 | Whitelaw et al. | |
| 2010/0184130 A1 | 7/2010 | Koprowski et al. | |
| 2010/0221400 A1 | 9/2010 | Chapman et al. | |
| 2011/0015415 A1 | 1/2011 | Singh et al. | |
| 2011/0054198 A1 | 3/2011 | Singh et al. | |
| 2011/0190521 A1 | 8/2011 | Damcevski et al. | |
| 2011/0201065 A1 | 8/2011 | Singh et al. | |
| 2011/0218348 A1 | 9/2011 | Zhou et al. | |
| 2011/0223311 A1 | 9/2011 | Liu et al. | |

(Continued)

FOREIGN PATENT DOCUMENTS

| | | |
|---|---|---|
| EP | 1806398 | 7/2007 |
| EP | 1837397 | 9/2007 |

(Continued)

OTHER PUBLICATIONS

Yang et al 2010 (PNAS early edition 1-6).*
Abdullah, R., Cocking, E. C., & Thompson, J. A. (Dec. 1986). Efficient plant regeneration from rice protoplasts through somatic embryogenesis. Biotechnology, 4, 1087-1090.
Andrianov et al. (2010) "Tobacco as a production platform for biofuel: overexpression of *Arabidopsis* DGAT and LEC2 genes increases accumulation and shifts the composition of lipids in green biomass" Plant Biotech. J. 8:277-287.
Agarwal et el. (2003) "Cottonseed Oil Quality, Utilization and Processing" CICR Technical Bulletin No. 25, pp. 1-16.
Aghoram, K., Wilson, R.F., Burton, J.W., Dewey, R.F. 2006. A mutation in a 3-keto-acyl-acp synthase ii gene is associated with elevated palmitic acid levels in soybean seeds. Crop Sci. 46:2453-2459.
Akagi et al. (1995) Nucleotide Sequence of a Stearoyl-Acel carrier Protein Desaturase cDNA from Developing Seeds of Rice. Plant Physiol. 108, 845-846.

(Continued)

*Primary Examiner* — Eileen B O Hara
*Assistant Examiner* — Matthew Keogh
(74) *Attorney, Agent, or Firm* — John P. White; Gary J. Gershik; Cooper & Dunham LLP

(57) ABSTRACT

The present invention relates to methods of producing lipids. In particular, the present invention relates to methods of increasing the level of one or more non-polar lipids and/or the total non-polar lipid content in a transgenic organism or part thereof. In one particular embodiment, the present invention relates to the use of an acyltransferase, for example, a monoacylglycerol acyltransferase (MGAT) to increase the level of one or more non-polar lipids and/or the total non-polar lipid content in plants, plant seed and/or leaves, algae and fungi.

20 Claims, 6 Drawing Sheets

(56) References Cited

U.S. PATENT DOCUMENTS

Figure 1:
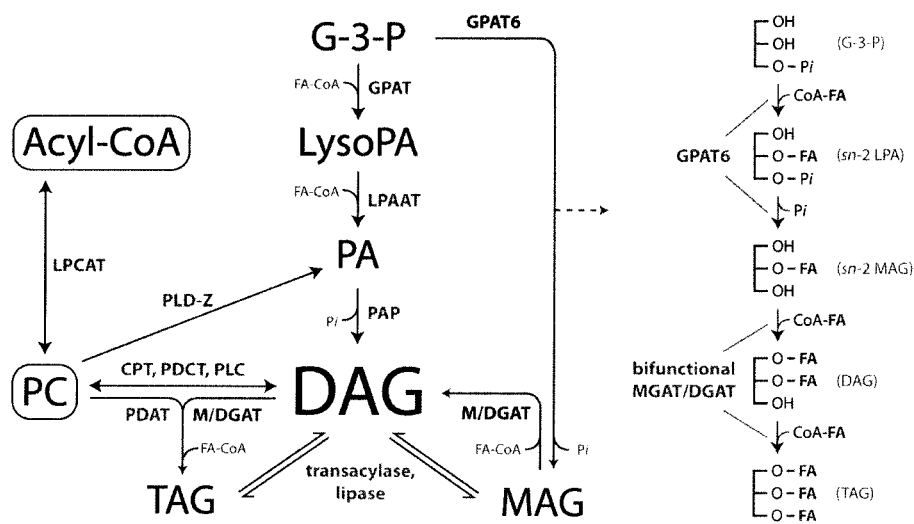

| | | |
|---|---|---|
| 2011/0229623 A1 | 9/2011 | Liu et al. |
| 2011/0314725 A1 | 12/2011 | Petrie et al. |
| 2012/0029252 A1 | 2/2012 | Lissianski et al. |
| 2013/0164798 A1 | 6/2013 | Vanhercke et al. |
| 2013/0247451 A1 | 9/2013 | Vanhercke et al. |
| 2014/0120225 A1 | 5/2014 | Whitelaw et al. |
| 2014/0256006 A1 | 9/2014 | Vanhercke et al. |
| 2014/0371477 A1 | 12/2014 | Wood et al. |
| 2015/0037457 A1 | 2/2015 | Vanhercke et al. |

FOREIGN PATENT DOCUMENTS

| | | |
|---|---|---|
| EP | 1944375 | 6/2008 |
| WO | WO 98/55631 | 12/1998 |
| WO | WO 99/49050 | 9/1999 |
| WO | WO 99/67268 | 12/1999 |
| WO | WO 99/67403 | 12/1999 |
| WO | WO 00/01713 | 1/2000 |
| WO | WO 00/11176 | 3/2000 |
| WO | WO 00/32756 | 6/2000 |
| WO | WO 00/32793 | 6/2000 |
| WO | WO 00/36114 | 6/2000 |
| WO | WO 00/60095 | 10/2000 |
| WO | WO 00/66750 | 10/2000 |
| WO | WO 00/66749 | 11/2000 |
| WO | WO 02/068595 | 9/2002 |
| WO | WO 03/078639 | 9/2003 |
| WO | WO 2004/011671 | 2/2004 |
| WO | WO 2004/042014 | 5/2004 |
| WO | WO 2005/003322 | 1/2005 |
| WO | WO 2005/063988 | 7/2005 |
| WO | WO 2005/103253 | 11/2005 |
| WO | WO 2007/107738 | 9/2007 |
| WO | WO 2008/025068 | 6/2008 |
| WO | WO 2008/130248 | 10/2008 |
| WO | WO 2008/147935 | 12/2008 |
| WO | WO 2008/157226 | 12/2008 |
| WO | WO 2008/157827 | 12/2008 |
| WO | WO 2009/027335 | 3/2009 |
| WO | WO 2009/085169 | 7/2009 |
| WO | WO 2009/129582 | 10/2009 |
| WO | WO 2009/143397 | 11/2009 |
| WO | WO 2010/009499 | 1/2010 |
| WO | WO 2010/009500 | 1/2010 |
| WO | WO 2010/057246 | 5/2010 |
| WO | WO 2012/000026 | 1/2012 |

OTHER PUBLICATIONS

Alemanno et al. (2008) "Characterization of leafy cotyledonl-like during embryogenesis in *Theobroma cacao* L." Planta 227:853-866.

Almeida and Allshire, (2005) "RNA silencing and genome regulation." Trends in Cell Biology, 15:251-258.

Alonso et al. (2010) "Catalytic conversion of biomass to biofuels" Green Chem. 12:1493-1513.

Anai et al. (2003) Improvement of rice (*Oryza sativa* L.) seed oil quality through introduction of a soybean microsomal omega-3 fatty acid desaturase gene. Plant Cell Rep. 21,988-992.

Ascherio and Willett (1997) "Health effects of trans fatty acids" Am. J. Clin. Nutr. 66: 1006S-1010S.

Awai et al., (2006) "A phosphatidic acid-binding protein of the chloroplast inner envelope membrane involved in lipid trafficking" PNAS 103(28):10817-22.

Barthole et al. (2011) "Controlling lipid accumulation in cereal grains" Plant Sci. 185-186:33-39.

Benning, (2008) "A role for lipid trafficking in chloroplast biogenesis" Progress in Lipid Research 47, 381-389.

Benning, (2009) "Mechanisms of Lipid Transport Involved in Organelle Biogenesis in Plant Cells" Annu. Rev. Cell Dev. Biol. 25:71-91.

Bligh and Dyer, (1959) "Orange-red Flesh in Cod and Haddock" J. Fish. Res. Bd. Canada, 16(4):449-452.

Bligh and Dyer (1959) "A Rapid Method of Total Lipid Extraction and Purification" Canadian Journal of Biochemistry and Physiology 37:911-917.

Boggs et al. (1964) "Relation of Hexanal in Vapor Above Stored Potato Granules to Subjective Flavor Extimates." J. Food Sci. 29:487-489.

Bonanome and Grundy (1988) "Effect of Dietary Stearic Acid on Plasma Cholesterol and Lipoprotein Levels" N. Engl. Med. 318: 1244-1248.

Bouvier-Nave et al. (2000) "Expression in yeast and tobacco of plant cDNAs encoding acyl CoA:diacylglycerol acyltransferase" European Journal of Biochemistry/FEBS 267:85-96.

Brandt et al., (1985) "Primary Structure of a B1 Hordein Gene from Barley" Carlsberg Res. Commun., 50:333-345.

Broun et al. (1998) "A bifunctional oleate 12-hydroxylase: desaturase from *Lesquerella fenleri*." The Pant Journal, 13(2):201-210.

Buhr et al. (2002) "Ribozyme termination of RNA transcripts down-regulate seed fatty acid genes in transgenic soybean" Plant J. 30:155-163.

Burgal et al., (2008) "Metabolic engineering of hydroxy fatty acid production in plants: RcDGAT2 drives dramatic increases in ricinoleate levels in seed oil" Plant Biotechnology Journal 6(8):819-831.

Cernac (2004) "WRINKLED1 encodes an AP2/EREB domain protein involved in the control of storage compound biosynthesis in *Arabidopsis*" The Plant Journal 40, 575-585.

Champagne et al. (1995) "Stabilization of Brown Rice Products Using Ethanol Vapors as an Antioxidant Delivery System" Cereal Chem 72:255-258.

Chang et al., (1978) "Chemical Reactions Involved in the Deep-Fat Frying of Foods." Journal of American Oil Chemists' Society, 55:718-727.

Chapman et al. (2001) "Transgenic Cotton Plants with Increased Seed Oleic Acid Content" Journal of American Chemists' Chemistry; vol. 78 No. 9, 941-947.

Chappell et al (1998) "Vegetable Oil Production: Industry Profile" Preliminary Final Report, EPA contract 68-D4-0099, TRU Project #7018-54, 1-1-5-26.

Cherry, (1983) "Cottonseed Oil" J. Am. Oil Chem. Soc. 60: 360-367.

Choudhury et al. (1980) "Lipids in Developing and Mature Rice Grain" Phytochemistry 19: 1063-1069.

Cicero et al. (2001) "Rice bran oil and [gamma]-oryzanol in the treatment of hyperlipoproteinaemias and other conditions" Phytotherapy Research; vol. 15 No. 4, 277-289.

Clapp et al., (1993) "The 16-Kilodalton N-Terminal Fragment of Human Prolactin is a Potent Inhibitor of Angiogenesis" Endocrinology, 133(3):1292-1299.

Colot et al., (1987) "Localization of sequences in wheat endosperm protein genes which confer tissue-specific expression in tobacco" The EMBO Journal, 6(12):3559-3564.

Comai et al., (2004) "Efficient discovery of DNA polymorphisms in natural populations by Ecotilling" The Plant Journal, 37:778-786.

Dougherty et al. (1995). Effects of diets containing high or low amounts of stearic acid on plasma lipoprotein fractions and fecal fatty acid excretion of men. Am. J. Clin. Nutr. 61:1120-1128.

Dowd et al., (2004) "Gene Expression Profile Changes in Cotton Root and Hypocotyl Tissues in Response to Infection with *Fusarium oxysporum* f. sp. *vasinfectum*" Molecular Plant-Microbe Interactions. 17: 654-667.

Dubois et al. (2007) "Fatty acid profiles of 80 vegetable oils with regard to their nutritional potential" European Journal of Lipid Science Technology 109(7):710-732.

Roston et al., (2012) "TGD1, -2, and -3 Proteins Involved in Lipid Trafficking Form ATP-binding Cassette (ABC) Transporter with Multiple Substrate-binding Proteins" The Journal of Biological Chemistry vol. 287, No. 25, pp. 21406-21415.

Rukmini and Raghuram (1991) "Nutritional and Biochemical Aspects of the Hypolipidemic Action of Rice Bran Oil: A Review." Journal of the American College of Nutrition 10(6):593-601.

Sanjaya et al., (2011) "Increasing the energy density of vegetative tissues by diverting carbon from starch to oil biosynthesis in transgenic *Arabidopsis*" Plant Biotechnology Journal 9, pp. 874-883.

Sanjaya et al (2013) "Altered Lipid Composition and Enhanced Nutritional Value of *Arabidopsis* Leaves following Introduction of an Algal Diacylglycerol Acyltransferase 2" Plant Cell, 1-17.

(56) References Cited

OTHER PUBLICATIONS

Semwal et al. (2011) "Biodiesel production using heterogeneous catalysts" Bioresource Technology 102:2151-2161.
Senior I.J., (1998) "Uses of Plant Gene Silencing." Biotechnology & Genetic Engineering Reviews, Ed. Tombs, M.P., 15:79-119.
Sheikh et al (2002) "Fatty Acids Composition in Germinating Cotton Seedlings Affected by High Temperature Stress" Pakistan Journal of Applied Sciences 2:1 p. 97-99.
Shenstone and Vickery, (1961) "Occurrence of Cyclo-Propene Acids in Some Plants of the Order Malvales" Nature 190: 68-169.
Shiina et al. (1997) "Identification of Promoter Elements Involved in Cytosolic Ca2+-Mediated Photoregulation of Maize cab-m1 Expression" Plant Physiol. 115:477-483.
Shin et al. (1986) "Correlation Between Oxidative Deterioration of Unsaturated Lipid and n-Hexanal during Storage of Brown Rice." J. Food Sci. 51:460-463.
Shippy, R., et al., (1999) "The Hairpin Ribozyme—Discovery, Mechanism, and Development for Gene Therapy," Molecular Biotechnology, 12(1): 117-129.
Singh et al. (2012) "Accumulating Triacylglycerol in leaves via the Monoacylglycerol Acyltransferase Pathway" 20th International Symposium on Plant Lipids.
Sivaraman et al. (2004) "Development of high oleic and low linoleic acid transgenics in a zero erucic acid *Brassica juncea L.* (Indian mustard) line by antisense suppression of the fad2 gene" Molecular Breeding, Kluwer Academic Publishers, DO; vol. 13 No. 1, 365-375.
Slade and Knauf, (2005) "Tilling moves beyond functional genomics into crop improvement." Transgenic Research, 14:109-115.
Smith et al. (2000) "Total silencing by intron-spliced hairpon RNAs" Nature 407:319-320.
Slocombe et al (2009) "Oil accumulation in leaves directed by modification of fatty acid breakdown and lipid synthesis pathways" Plant Biotechnology Journal, 7, 694-703.
Srinivasan et al. (2007) "Heterologous expression of the Baby Boom AP2/ERF transcription factor enhances the regeneration capacity of tobacco (*Nicotiana tabacum L.*)" Planta 225:341-51.
Stalberg et al., (1993) "Deletion Analysis of a 2S Seed Storage Protein Promoter of *Brassica napus* in Transgenic Tobacco," Plant Molecular Biology, 23(4): 671-683.
St Angelo et al. (1980) "Identification of Lipoxygenase-Linoleate Decomposition Products by Direct Gas Chromatography-Mass Spectrometry." J Lipids 1:45-49.
Stoutjesdiik et al. (2002) "hpRNA-mediated targeting of the *Arabidopsis* FAD2 gene gives highly efficient and stable silencing" Plant Physiology, American Society of Plant Physiologists, Rockville, MD, US; vol. 129, 1723-31.
Stoutjesdijk et al., (2000) "High-oleic acid Australian *Brassica napus* and *B. juncea* varieties produced by co-suppression of endogenous Δ12-desaturases." Biochem. Soc. Trans. 28: 938-940.
Suzuki et al. (1999) "Volatile Components in Stored Rice [*Oryza sativa* (L.)] of Varieties with and without Lipoxygenase-3 in Seeds." J. Agric. Food Chem. 47: 1119-1124.
Taira et al. (1989) "Fatty Acid Composition of Indica-Types and Japonica-Types of Rice Bran and Milled Rice" Journal of the American Oil Chemists' Society; vol. 66 No. 9, 1326-1329.
Taira et al. (1988) "Fatty Acid Composition of *Indica sinica javanica* and *Japonica* Groups of Nonglutinous Brown Rice" Journal of Agricultural and Food Chemistry; vol. 36 No. 1, 45-47.
Taira et al. (1986) "Lipid Content and Fatty-Acid Composition of *Indica* and *Japonica* Types of Nonglutinous Brown Rice" Journal of Agriculture and Food Chemistry; vol. 34 No. 3, 542-545.
Taira and Chang (1986) "Lipid content and fatty acid composition of *Indica* and *Japonica* types of nonglutinous brown rice." Agric. Food Chem. 34:542-545.
Takeyama, H., et al., (1997) "Expression of the Eicosapentaenoic Acid Synthesis Gene Cluster From *Shewanella* sp. in a Transgenic Marine Cyanobacterium, *Synechococcus* sp.," Microbiology, 143(Pt 8):2725-2731.
Thelen and Ohlrogge (2002) "Metabolic Engineering of Fatty Acid Biosynthesis in Plants." Metabolic Engineering 4: 12-21.

Theriault et al. (1999). "Tocotrienol: A Review of its Therapeutic Potential." Clin. Biochem. 32: 309-19.
Tholstrup et al. (1994) "Fat high in stearic acid favorably affects blood lipids and factor VII coagulant activity in comparison with fats high in palmitic acid or high in myristic and lauric acids." Am. J. Clin. Nutr. 59: 371-377.
To et al., (2012) "WRINKLED Transcription Factors Orchestrate Tissue-Specific Regulation of Fatty Acid Biosynthesis in *Arabidopsis*" The Plant Cell, vol. 24: 5007-5023.
Toriyama et al., "Haploid and diploid plant regeneration from protoplasts of anther callus in rice." Theor Appl Genet, 1986, 73:16-19.
Tsugita et al (1983) "Cooking Flavor and Texture of Rice Stored under Different Conditions." Agricultural and Biological Chemistry 47: 543-549.
Tsuzuki et al (2004) "Oxidation Rate of Conjugated Linoleic Acid and Conjugated Linolenic Acid is Slowed by Triacylglycerol Esterification and α-Tocopherol." Lipids 39:475-480.
Trautwein, E.A., (2001) "n-3 Fatty Acids—Physiological and Technical Aspects for Their Use in Food," European Journal of Lipid Science and Technology, 103(1): 45-55.
Valvekens, D., et al., (1988) "*Agrobacterium tumefaciens*-Mediated Transformation of *Arabidopsis thaliana* Root Explants by Using Kanamycin Selection," Proceedings of the National Academy of Sciences of the United States of America, 85(15) 5536-5540.
van de Loo, F. J., Broun, P., Turner, S., & Somerville, C. (1995) "An oleate 12-hydroxylase from *Ricinus communis* L. is a fatty acyl desaturase homolog." Proc. Natl. Acad. Sci. USA, 92, 6743-6747.
Vanhercke et al. (2012) "Maximizing lipid accumulation in vegetative plant tissues" 8th International Symposium on Biocatalysis and Agricultural Biotechnology.
Vanhercke et al. (2013) "Synergistic effect of WRI1 and DGAT1 coexpression on triacylglycerol biosynthesis in plants" FEBS Letters 587:364-369.
Vanhercke et al (2013) "Metabolic engineering of biomass for high energy density: oilseed-like triacylglycerol yields from plant leaves" Plant Biotechnol. J., doi: 10.1111/pbi.12131 (pp. 1-9).
Voelker et al. (1996) "Genetic engineering of a quantitative trait: metabolic and genetic parameters influencing the accumulation of laurate in rapeseed." Plant J. 9: 229-241.
Wagner et al. (1992) "Coupling of adenovirus to transferrin-polylysine/DNA complexes greatly enhances receptor-mediated gene delivery and expression of transfected genes." Proc. Natl. Acad. Sci. USA, 89, 6099-6103.
Wang et al., (1998) "Improved Vectors for *Agrobacterium tumefaciens*-Mediated Transformation of Monocot Plants." Acta Hort, 1998, 461:401-407.
Waterhouse, P.M., et al., (1998) "Virus Resistance and Gene Silencing in Plants Can Be Induced by Simultaneous Expression of Sense and Antisense RNA," Proceedings of the National Academy of Sciences of the United States of America, 95(23): 13959-13964.
Weselake et al. (2009) "Increasing the flow of carbon into seed oil" Biotechnology Advances 27:866-878.
Williams et al. (1999) "Impaired Endothelial Function Following a Meal Rich in Used Cooking Fat." J. Am. Coll. Cardiol. 33:1050-1055.
Whitelaw et al. (1986) "A Rice FATB Insertional Mutant Exhibits Improved Growth and Reduced Photoinhibition at High Temperatures" Proceedings of the 55th Australian Cereal Chemistry Conference, 55th Australian Cereal Chemistry Conference, Jul. 3-7, 2008, Sydney Australia, Jul. 3, 2005, pates 101-104.
Whitelaw et al., (2004) "Investigation of lipid synthesis in the rice grain: modification of fatty acids in rice bran oil." in C.K. Black, J.F. Panozzo, and G.J. Rebetzke (Eds.), Cereals 2004: Proceedings of the 54th Australian Cereal Chemistry Conference and 11th Wheat Breeders Assembly, 21st-245th Sep. 2004, Canberra ACT, North Melbourne VIC: Cereal Chemistry Division, Royal Australian Chemical Institute, AU (pp. 418-420).
Wood et al. (2009) "A leaf-based assay using interchangeable design principles to rapidly assemble multistep recombinant pathways" Plant Biotech. J. 7: 914-924.
Xu et al., (2008) "Cloning and characterization of an acyl-CoA-dependent diacylglycerol acyltransferase 1 (DGAT1) gene from

(56) References Cited

OTHER PUBLICATIONS

*Tropaeolum majus*, and a study of the functional motifs of the DGAT protein using site-directed mutagenesis to modify enzyme activity and oil content" Plant Biotechnology Journal 6, pp. 799-818.
Xu et al., (2008) "Lipid Trafficking between the Endoplasmic Reticulum and the Plastid in *Arabidopsis* Requires the Extraplastidic TGD4 Protein" The Plant Cell, vol. 20: 2190-2204.
Xu et al., (2005) "Mutation of the TGD1 Chloroplast Envelope Protein Affects Phosphatidate Metabolism in *Arabidopsis*" The Plant Cell, vol. 17, 3094-3110.
Xu et al., (2010) "Lipid Transport Mediated by *Arabidopsis* TGD Proteins is Unidirectional from the Endoplasmic Reticulum to the Plastid" Plant Cell Physiol, 51(6): 1019-1028.
Yang et al. (2010) "A distinct type of glycerol-3-phosphate acyltransferase with sn-2 preference and phosphatase activity producing 2-monoacylglycerol" PNAS 107:12040-12045.
Yang & Ohlrogge (2009) "Turnover of Fatty Acids during Natural Senescence of *Arabidopis, Brachypodium*, and Switchgrass and in *Arabidopsis* b-Oxidation Mutants" Plant Physiology, 150, 1981-1989.
Yasumatsu et al. (1966) "Studies on Cereals Part V Stale Flavor of Stored Rice." Agric. Biol. Chem. 30:483-486.
Zhou et al. (2002) "Ageing of Stored Rice: Changes in Chemical and Physical Attributes," Journal of Cereal Science 35:65-78.
Zock et al. (1994) "Impact of myristic acid versus palmitic acid on serum lipid and piloprotein levels in healthy women and men." Arterioscler Thromb. 14: 567-575.
Liu et al., (2005) GenBank Accession No. AY574036.
Liu et al., (2005) GenBank Accession No. AY574037.
Liu et al., (2005) GenBank Accession No. AY574038.
Connolly et al. (1998) GenBank Accession No. AC004236, NCBI, pp. 1-11.
Sharma et al., (2003) GenBank Accesion No. AC108870, NCBI, pp. 1-27.
Kim et al., (1999) GenBank Accesion No. AF213480, NCBI, p. 1.
Sasaki et al., (2001) GenBank Accession No. AP004047, NCBI, pp. 1-36.
Sasaki et al., (1999) GenBank Accession No. AP000399, NCBI, pp. 1-33.
Sasaki et al., (2001) GenBank Accession No. AP004236, NCBI, pp. 1-37.
Sasaki et al., (2002) GenBank Accession No. AP005168, NCBI, pp. 1-31.
Sasaki et al., (2002) GenBank Accession No. AP005291, NCBI, pp. 1-38.
Sasaki et al., (2002) GenBank Accession No. BAC45173.1.
Sasaki et al., (2002) GenBank Accession No. BAC45170.1.
File History of U.S. Patent Publication No. 2011-0223311, Liu et al., published Sep. 15, 2011 (U.S. Appl. No. 13/011,773, filed Jan. 21, 2011).
File History for U.S. Patent Publication No. 2009-0308041, Whitelaw et al., Dec. 17, 2009 (U.S. Appl. No. 12/309,276, filed Jul. 6, 2009).
File History of U.S. Patent Publication No. 2011-0229623, Liu et al., Sep. 22, 2011 (U.S. Appl. No. 13/011,779, filed Jan. 21, 2011).
Dulermo and Nicaud (2011) "Involvement of the G3P shuttle and β-oxidation pathway in the control of TAG synthesis and lipid accumulation in *Yarrowia lipolytica*" Metab. Eng. 13:482-491.
Durret et al. (2008) "Plant triacylglycerols as feedstocks for the production of biofuels" Plant J. 54:593-607.
Eastmond, (2006) "SUGAR-DEPENDENT1 Encodes a Patatin Domain Triacylglycerol Lipase That Initiates Storage Oil Breakdown in Germinating *Arabidopsis* Seeds" The Plant Cell, vol. 18, 665-675.
Endalew et al. (2011) "Inorganic heterogeneous catalysts for biodiesel production from vegetable oils" Biomass and Bioenergy 35:3787-3809.
Folch et al., (1957) "A Simple Method for the Isolation and Purification of total Lipides Prom Animal Tissues" J. Biol. Chem. 226: 497.
Fuller et al., (1966) "A Gas Chromatographic Method for Continuous Accelerated Study of $O_2$ Uptake in Fats" JAOCS. 43: 477-478.

Ghosal et al. (2007) "*Saccharomyces cerevisiae* phospholipid-:diacylglycerol acyl transferase (PDAT) devoid of its membrane anchor region is a soluble and active enzyme retaining its substrate specificities" Biochimica et Biophysica Acta 1771:1457-1463.
Goffman et al., (2003) "Genetic Diversity for Lipid Content and Fatty Acid Profile in Rice Bran," Journal of the American Oil Chemists' Society 80:485-490.
Gong and Jiang (2011) "Biodiesel production with microalgae as feedstock: from strains to biodiesel" Biotechnol. Lett. 33:1269-1284.
Greenwell et al. (2010) "Placing microalgae on the biofuels priority list: a review of the technological challenges" J. R. Soc. Interface 7:703-726.
Ha (2005) "Bioactive components in rice bran oil improve lipid profiles in rats fed on high-cholesterol diet" Nutrition research 25, 597-606.
Haseloff, J. and Gerlach, W.L., (1988) "Simple RNA Enzymes With New and Highly Specific Endoribonuclease Activities," Nature, 734: 585-591.
Henikoff et al., (2004) "TILLING. Traditional Mutagenesis Meets Functional Genomics." Plant Physiology, 2004, 135:630-636.
Hu et al. (1997) "Dietary Fat Intake and the Rist of Coronary Heart Disease in Women." N. Engl. J. Med. 337: 1491-1499.
Hutchins et al., (1968) "A New Process for the Selective Hydrogenation Cyclopropenoids in Cottonseed Oil" Journal of American Oil Chemists Society 45: 397-399.
Jain et al., (2000) "Enhancement of seed oil content by expression of glycerol-3-phosphate acyltransferase genes" Biochemical Society Transactions 28(6):958-961.
James et al (2010) "Disruption of the *Arabidopsis* CGI-58 homologue produces Chanarin-Dorfman-like lipid droplet accumulation in plants," 107(41):17833-17838 and supporting information pp. 1-3.
Jennings and Akoh (2000) "Lipase-Catalyzed Modification of Rice Bran Oil to Incorporate Capric Acid." Journal of Agricultural and Food Chemistry, 48:4439-4443.
Jones et al. (1995) "Palmitoyl-Acyl Carrier Protein (ACP) Thioesterase and the Evolutionary Origin of Plant Acyl-ACP Thioesterases." Plant Cell 7: 359-371.
Karmakar et al. (2010) "Properties of various plants and animals feedstocks for biodiesel production" Bioresource Technology 101:7201-7210.
Kargiotidou et al., (2008) "Low temperature and light regulate delta 12 fatty acid desaturases (FAD2) at a transcriptional level in cotton (*Gossypium hirsutum*)" Journal of Experimental Botany 2008 59(8): 2043-2056.
Kelly et al., (2012) "Suppression of the SUGAR-DEPENDENT1 triacylglycerol lipase family during seed development enhances oil yield in oilseed rape (*Brassica napus* L.)" Plant Biotechnology Journal, pp. 1-7.
Kelly et al., (2011) "Seed Storage Oil Mobilization Is Important But Not Essential for Germination or Seedling Establishment in *Arabidopsis*" Plant Physiology, vol. 157, pp. 866-875.
Kinney (1996) "Development of Genetically Engineered Soybean Oils for Food Applications." J. Food Lipids 3: 273-292.
Klahre et al. (2002) "High molecular weight RNAs and small interfering RNAs induce systemic posttranscriptional gene silencing in plants." PNAS 99(18): 11981-11986.
Kodama et al. (1997) "Structure, chromosomal location and expression of a rice gene encoding the microsome ω-3 fatty acid desaturase." Plant Molecular Biology 33:493-502.
Kohno-Murase et al. (2006) "Production of trans-10, cis-12 conjugated linoleic acid in rice." Transgenic Research 15:95-100.
Kozeil et al. (1996) "Optimizing expression of transgenes with an emphasis on post-transcriptional events." Plant Molecular Biology, 32:393-405.
Langridge et al., Trends in genetic and genome analysis in wheat: a review. Aust. J. Agric. Res., 2001, 52:1043-1077.
Lardizabal et al. (2001) "DGAT2 Is a New Diacylglycerol Acyltransferase Gene Family" J. Biol. Chem. 276:38862-38869.
Lardizabal et al. (2008) "Expression of *Umbelopsis ramanniana* DGAT2A in Seed Increases Oil in Soybean" Plant Physiol. 148: 89-96.

(56) References Cited

OTHER PUBLICATIONS

Lemieux B., (2000) "High Throughput Single Nucleotide Polymorphism Genotyping Technology." Current Genomics, 2000, 1:301-311.
Leonard et al. (1997) "*Cuphea wrightii* thioesterases have unexpected broad specificities on saturated fatty acids." Plant Molecular Biology, vol. 34, Issue 4: 669-679.
Li et al., (1997) "Comparison of promoters and selectable marker genes for use in Indica rice transformation," Molecular Breeding, 3:1-14.
Liu et al., (2002) "High-Stearic and High-Oleic Cottonseed Oils Produced by Hairpin RNA-Mediated Post-Transcriptional Gene Silencing." Plant Physiology, 129(4):1732-1743.
Liu et al. (2010) "Producing biodiesel from high free fatty acids waste cooking oil assisted by radio frequency heating" Fuel 89:2735-2740.
Liu et al. (1999) "Molecular cloning and expression of a cDNA encoding a microsomal ω-6 fatty acid desaturase from cotton (*Gossypium hirsutum*)" Aust. J. Plant Physiol. 26:101-106.
Liu et al. (1997) EMBL Nucleotide Sequence Database as X97016.
Liu et al. (2000) "Genetic modification of cotton seed oil using inverted-repeat gene-silencing techniques." Biochemical Society Transations, 28(6):927-929.
Liu et al. (2002) "High-Oleic and High-Stearic Cottonseed Oils: Nutritionally Improved Cooking Oils Developed Using Gene Silencing." J. Am. Coll. Nutr. 21: 205S-211S.
Liu et al., (1999) "Cloning and Sequence Analysis of a Novel Member (Accession No. Y10112) of the Microsomal w-6 Fatty Acid Desaturase Family from Cotton" Plant Physiol. (PGR 99-063) 120: 339.
Lu et al., (2011) "New frontiers in oilseed biotechnology: meeting the global demand for vegetable oils for food, feed, biofuel, and industrial applications" Current Opinion in Biotechnology, 22:252-259.
Lu et al. (1993) "High efficiency retroviral mediated gene transduction into single isolated immature and replatable CD343+ hematopoietic stem/progenitor cells from human umbilical cord blood." J. Exp. Med., 178, 2089-2096.
Maher and Bressler (2007) "Pyrolysis of triglyceride materials for the production of renewable fuels and chemicals" Bioresource Technology 98:2351-2368.
Mensink and Katan (1990) "Effect of Dietary Trans Fatty Acids on High-Density and Low-Density Lipoprotein Cholesterol Levels in Healthy Subjects." N. Engl. J. Med. 323: 439-445.
Mikkilineni and Rocheford (2003) "Sequence variation and genomic organization of fatty acid desaturase-2 (fad2) and fatty acid desaturase-6 (fad6) cDNAs in maize." Theor. Applied Genetics, 106, 1326-1332.
Millar and Waterhouse (2005) "Plant and animal microRNAs: similarities and differences." Funct Integr Genomics, 2005, 5:129-135.
Miquel et al. (1992) "*Arabidopsis* mutants deficient in polyunsaturated fatty acid synthesis: Biochemical and genetic characterization of a plant oleoyl-phosphatidylcholine desaturase" Journal of Biological Chemistry; vol. 267 No. 3, 1502-1509.
Moghadasian and Frohlich (1999) "Effects of Dietary Phytosterols on Cholesterol Metabolism and Atherosclerosis: Clinical and Experimental Evidence." Am. J. Med. 107: 588-94.
Mojovic et al., (1993) "*Rhizopus arrhizus* lipase-catalyzed interesterification of the midfraction of palm oil to a cocoa butter equivalent fat" Enzyme Microb Technol. 15: 438-443.
Morrison (1988) "Lipids in Cereal Starches: A Review." J Cereal Sci. 8:1-15.
Most et al. (2005) "Rice bran oil, not fiber, lowers cholesterol in humans." Am J Clin Nutr 81:64-8.
Mounts et al., (1998) "Effect of Altered Fatty Acid Composition on Soybean Oil Stability" J Am. Oil Chem. Soc. 65: 624-628.
Nielsen et al. (2004) Formation of Volatile Compounds in Model Experiments with Crude Leek (*Allium ampeloprasum* Var. Lancelot) Enzyme Extract and Linoleic Acid or Linolenic Acid. Journal of Agricultural and Food Chemistry 52:2315-2321.
Noakes and Clifton (1998) "Oil blends containing partially hydrogenated or interesterified fats: differential effects on plasma lipids." Am. J. Clin. Nutr. 98: 242-247.
O'Brien, (2002) Cottonseed Oil. In: F.D. Gunstone (Ed.) Vegetable Oils in Food Technology: Composition, Properties and Uses. Blackwell Publishing, Oxford, pp. 203-230.
O'Brien (2005) "Cottonseed Oil" Bailey's Industrial Oil and Fat Products, 6th Edition, edited by Fereidoon Shahidi.
Okuley et al. (1994) "*Arabidopsis* FAD2 Gene Encodes the Enzyme that is Essential for Polyunsaturated Lipid Synthesis." Plant Cell, 6:147-158.
Ohlrogge and Jaworski (1997) "Regulation of Fatty Acid Synthesis. Annu Rev Plant Physiol Plant Mol Biol." 49:109-136.
Parthibane et al. (2012) "Oleosin is a Bifunctional Enzyme That Has Both Monoacylglycerol Acyltransferase and Phospholipase Activities" J. Biol. Chem. 297:1946-1954.
Perez-Vich et al. (1998) "Determination of Seed Oil Content and Fatty Acid Composition in Sunflower Through the Analysis of Intact Seeds, Husked Seeds, Meal and Oil by Near-Infrared Reflectance Spectroscopy" JAOCS 75:547-555.
Perriman, R., et al., (1992) "Extended Target-Site Specificity for a Hammerhead Ribozyme," Gene, 113(2): 157-163.
Petrie et al., (2012) "Recruiting a New Substrate for Triacylglycerol Synthesis in Plants: The Monoacylglycerol Acyltransferase Pathway" PLoS ONE 7(4): e35214, pp. 1-8.
Pirtle et al. (1999) "Characterization of a Palmitoyl-Acyl Carrier Protein Thioesterase (FatB1) in Cotton" Plant Cell Physiology 40:2 p. 155-163.
Pirtle et al., (2001) "Molecular cloning and functional expression of the gene for a cotton v-12 fatty acid desaturase (FAD2)" Biochim. Biophys. Acta 1522: 122-129.
Pokharkar et al., (2008) "Synthesis and Characterization of Fatty Acid Methyl Ester by In-Situ Transesterification in *Capparis deciduas* Seed" Leonardo Electronic Journal of Practices and Technologies 13:12-18.
Rajasekharan et al., (2006) "Monoacylglycerol as an intermediate in triacylglycerol biosynthesis in pants" International Symposium on Plant Lipids, Abstract.
Radcliffe et al. (1997) "Serum Lipids in Rats Fed Diets Containing Rice Bran Oil or High-Linolenic Acid Safflower Oil." Biochemical Archives 3:87-95.
Resurreccion et al. (1979) "Nutrient Content and Distribution in Milling Fractions of Rice Grain." Journal of the Science of Food and Agriculture, 30: 475-481.
Roche and Gibney (2000) "Effect of long-chain n-3 polyunsaturated fatty acids on fasting and postprandial triacylglycerol metabolism." Am. J. Clin. Nutr. 71: 232S-237S.
U.S. Appl. No. 13/011,779, filed Jan. 21, 2011, Liu et al.
U.S. Appl. No. 12/989,405, filed May 16, 2011, Zhou et al.
U.S. Appl. No. 13/129,940, filed May 18, 2011, Petrie et al.
U.S. Appl. No. 13/011,773, filed Jan. 21, 2011, Liu et al.
U.S. Appl. No. 13/243,747, filed Sep. 23, 2011, Singh et al.
Bao and Ohlrogge, Supply of Fatty Acid is One Limiting Factor in the Accumulation of Triacylglycerol in Developing Embryos. Plant Physiology, 1999, 120:1057-1062.
Bäumlein, H., et al., A Novel Seed Protein Gene From *Vicia faba* is Developmentally Regulated in Transgenic Tobacco and *Arabidopsis* Plants. Molecular and General Genetics, 1991, 225(3): 459-467.
Cao et al., Properties of the Mouse Intestinal Acyl-CoA:Monoacylglycerol Acyltransferase, MGAT2. The Journal of Biological Chemistry, 2003, 278(28)25657-25669.
Cases et al., Identification of a gene encoding an acyl CoA:diacylglycerol acyltransferase, a key enzyme in triacylglycerol synthesis. PNAS, 1998, 95:13018-13023.
Cases et al., Cloning of DGAT2, a second mammalian diacylglycerol acyltransferase, and related family members. J. Biol. Chem., 2001, 276(42):38870-38876.
Cheng et al., Identification of Acyl Coenzyme A:Menoacylglycerol Acyltransferase 3, an Intestinal Specific Enzyme Implicated in Dietary Fat Absorption. The Journal of Biological Chemistry, 2003, 278(126):13611-13614.

(56) References Cited

OTHER PUBLICATIONS

Domergue et al., In vivo characterization of the first acyl-CoA Δ6-desaturase from a member of the plant kingdom, the microalga *Ostreococcus tauri*. Biochem J., 2005, 389, 483-490.
Jako et al., Seed-Specific Over-Expression of an *Arabidopsis* cDNA Encoding a Diacylglycerol Acyltransferase Enhances Seed Oil Content and Seed Weight. Plant Physiology, 2001, 126:861-874.
Lee et al., Identification of Non-Heme Diiron Proteins That Catalyze Triple Bond and Epoxy Group Formation. Science, 1998, 280(5365): 915-918.
Needleman, S. B., & Wunsch, C. D., A general method applicable to the search for similarities in the amino acid sequence of two proteins. J. Mol. Biol., 1970, 48, 443-453.
Stålberg, K., et al., Deletion Analysis of a 2S Seed Storage Protein Promoter of *Brassica napus* in Transgenic Tobacco. Plant Molecular Biology, 1993, 23(4): 671-683.
Trautwein, E.A., n-3 Fatty Acids—Physiological and Technical Aspects for Their Use in Food. European Journal of Lipid Science and Technology, 2001, 103(1): 45-55.
Valvekens, D., et al., *Agrobacterium tumefaciens*-Mediated Transformation of *Arabidopsis thaliana* Root Explants by Using Kanamycin Selection. Proceedings of the National Academy of Sciences of the United States of America, 1988, 85(15) 5536-5540.
Van de Loo et al., An oleate 12-hydroxylase from *Ricinus communis* L. is a fatty acyl desaturase homolog. Proc. Natl. Acad. Sci. USA, 1995, 92, 6743-6747.
Yen et al., Identification of a gene encoding MGAT1, a monoacylglycerol acyltransferase. PNAS, 2002, 99(13):8512-8517.
File History of U.S. Patent No. 7,807,849, Singh et al., issued Oct. 5, 2010 (U.S. Appl. No. 11/112,882, filed Apr. 22, 2005).
File History of U.S. Patent Application Publication No. 2011/0015415, Singh, et al., published Jan. 20, 2011 (U.S. Appl. No. 12/661,978, filed Mar. 26, 2010).
File History of U.S. Patent No. 7,834,250, Singh et al., issued Nov. 16, 2010 (U.S. Appl. No. 11/587,092, filed Oct. 20, 2006).
File History of U.S. Patent No. 7,932,438, Singh et al., issued (U.S. Appl. No. 12/945,708, filed Nov. 12, 2010).
File History of U.S. Patent Application Publication No. 2011/0201065, Singh et al., published Aug. 18, 2011 (U.S. Appl. No. 13/093,252, filed Apr. 25, 2011).
File History of U.S. Patent Application Publication No. 2011/0190521, Damcevski et al., published Aug. 4, 2011 (U.S. Appl. No. 12/310,645, filed Feb. 16, 2011).
File History of U.S. Patent Application Publication No. 2011/0218348, Zhou et al., published Sep. 8, 2011 (U.S. Appl. No. 12/989,405, filed May 16, 2011).
File History of U.S. Patent No. 7,589,253, Green et al., issued Sep. 15, 2009 (U.S. Appl. No. 09/981,124, filed Oct. 17, 2011).
File History of U.S. Patent No. 7,834,248, Green et al., issued Nov. 16, 2010 (U.S. Appl. No. 11/699,817, filed Jan. 30, 2007).
PCT International Patent Application International Search Report, issued Dec. 6, 2011 for the related application PCT/2001/000794.
PCT International Patent Application Written Opinion, issued Dec. 6, 2011 for the related application PCT/2001/000794.
International Search Report and Written Opinion of the International Searching Authority issued Apr. 8, 2013 in connection with PCT International Patent Application No. PCT/AU2012/001598, which claims priority of U.S. Appl. No. 61/718,563, filed Oct. 25, 2012 and U.S. Appl. No. 61/580,590, filed Dec. 27, 2011.
Apr. 30, 2013 Office Action, issued in connection with U.S. Appl. No. 13/725,404.
Jun. 19, 2013 Examiner Interview Summary, issued in connection with U.S. Appl. No, 13/725,404.
Jul. 8, 2013 Response, filed in connection with U.S. Appl. No. 13/725,404.
Sep. 23, 2013 Notice of Allowance, Examiner's Amendment, and Examiner Interview Summary, issued in connection with U.S. Appl. No. 13/725,404.
Oct. 18, 2013 Amendment After Allowance and Examiner Interview Summary, filed in connection with U.S. Appl. No. 13/725,404.
Oct. 30, 2013 Response filed in connection with U.S. Appl. No. 13/841,641.
U.S. Appl. No. 14/269,858, filed May 5, 2014 (Liu et al.).
Jul. 30, 2013 Office Action, issued in connection with U.S. Appl. No. 13/841,641.
Oct. 30, 2013 Response, filed in connection with U.S. Appl. No. 13/841,641.
Jan. 27, 2014 Supplemental Amendment, filed in connection with U.S. Appl. No. 13/841,641.
Apr. 1, 2014 Notice of Allowance and Interview Summary, issued in connection with U.S. Appl. No. 13/841,641.
Dec. 31, 2013 Office Action, issued in connection with U.S. Appl. No. 13/725,404.
Jan. 27, 2014 Response, filed in connection with U.S. Appl. No. 13/725,404.
Feb. 18, 2014 Notice of Allowance and Interview Summary, issued in connection with U.S. Appl. No. 13/725,404.
Jan. 28, 2014 Extended European Search Report, issued in connection with European Patent Publication No. 11799957.3.
Aug. 21, 2014 Response to Search Report, filed in connection with European Patent Publication No. 11799957.3.
Jul. 10, 2014 Third Party Observations, filed in connection with European Patent Publication No. 11799957.3.
English language translation of Jan. 6, 2014 First Office Action, issued in connection with Chinese Patent Application No. 201180041568.2.
May 21, 2013 Response to Office Action, filed in connection with Chinese Patent Application No. 201180041568.2.
Sep. 2, 2013 First Examination Report, issued in connection with Australian Patent Application No. 2011274301.
Feb. 13, 2014 Amendments, filed in connection with South African Patent Application No. 2013/00684.
Shockey et al. (2006) Tung Tree DGAT1 and DGAT2 Have Nonredundant Functions in Triacylglycerol Biosynthesis and Are Localized to Different Subdomains of the Endoplasmic Reticulum. The Plant Cell, 18:2294-2313.
Tumaney et al. (2001) Identification, Purification, and Characterization of Monoacylglycerol Acyltransferase from Developing Peanut Cotyledons. The Journal of Biological Chemistry, 276(14):10647-10852.
File History of U.S. Patent Application Publication No. 2013/0164798, Vanhercke et al., published Jun. 27, 2013 (U.S. Appl. No. 13/725,404, filed Dec. 21, 2012).
File History of U.S. Patent Application Publication No. 2013/0247451, Vanhercke et al., published Sep. 26, 2013 (U.S. Appl. No. 13/841,641, filed Mar. 15, 2013).
Sep. 12, 2014 Second Chinese Office Action, issued in connection with Chinese Patent Application No. 201180041568.2, including English language translation.
Jan. 23, 2015 Response to the Second Chinese Office Action, filed in connection with Chinese Patent Application No. 201180041568.2.
Oct. 10, 2014 First Examination Report, issued in connection with Australian Patent Application No. AU2013204308.
Apr. 24, 2015 Response to Examination Report, filed in connection with Australian Patent Application No. AU2011274301.
May 19, 2015 Voluntary Amendment, filed in connection with Australian Patent Application No. AU2011274301.
Oct. 29, 2014 Communication under Article 94(3) EPC, issued in connection with European Patent Application No. EP11799957.3.
May 7, 2015 Response to Communication under Article 94(3) EPC, filed in connection with European Patent Application No. EP11799957.3.
Jun. 18, 2015 Communication under Article 94(3) EPC, issued in connection with European Patent Application No. EP11799957.3.
Jun. 5, 2015 Second Office Action, issued in connection with Russian Federation Patent Application No. 2013102419, including English Language Translation.

\* cited by examiner

METHODS OF PRODUCING LIPIDS

This application claims priority of Australian Patent Application No. 2010902841, filed Jun. 28, 2010 and benefit of U.S. Provisional Applications Nos. 61/399,286, filed Jul. 9, 2010 and 61/485,349, filed May 12, 2011, the contents of each of which are hereby incorporated by reference into this application.

This application incorporates-by-reference nucleotide and/or amino acid sequences which are present in the file named "110824_2251_81870_A_SEQUENCELISTIN-G_REB.TXT", which is 647 kilobytes in size, and which was created August 24, 2011 in the IBM-PC machine format, having an operating system compatibility with MS-Windows, which is contained in the text file filed August 24, 2011 as part of this application.

FIELD OF THE INVENTION

The present invention relates to methods of producing lipids. In particular, the present invention relates to methods of increasing the level of one or more non-polar lipids and/or the total non-polar lipid content in a transgenic organism or part thereof. In one particular embodiment, the present invention relates to the use of an acyltransferase, for example, a monoacylglycerol acyltransferase (MGAT) to increase the level of one or more non-polar lipids and/or the total non-polar lipid content in plants, plant seed and/or leaves, algae and fungi.

BACKGROUND OF INVENTION

Plant lipids such as seedoil triaclyglycerols (TAGs) have many uses, for example, culinary uses (shortening, texture, flavor), industrial uses (in soaps, candles, perfumes, cosmetics, suitable as drying agents, insulators, lubricants) and provide nutritional value. There is also growing interest in using plant lipids for the production of biofuel.

Biofuel

Growing demand for alternative sources of energy can be fulfilled at least in part with a renewable supply of plant-derived biofuel. To be a viable alternative to fossil fuels, the biofuel should provide a net energy gain in production, have environmental benefits, be economically competitive, and producible in large quantities without reducing food supplies, a current unintended byproduct of existing biofuel production.

Plants represent a significant source of lipids because many species accumulate lipids as major storage components in seeds. The main form of vegetative storage lipids in seeds, which represent, depending on the species, 15-50% of seed weight, is triacylglycerol (TAG). However, the primary substrate for lipid synthesis are the carbohydrates generated in green photosynthetic tissues (leaves and stems) that are subsequently metabolized in chloroplasts to produce free fatty acids and acetyl-coenzyme A (acetyl-CoA) units, the basic building blocks for TAG. Therefore, plant leaves are the main place of building block synthesis for TAG. The amount of TAG accumulated in oilseeds may be in part, determined by the amount of fatty acid produced in plastids (Bao and Ohlrogge, 1999). Final storage of TAG occurs in seeds in small spherical organelles termed oil bodies. Only about 0.2-0.3% of leaf biomass is represented by TAG.

High biomass plants, particularly broad leaf high biomass plants, have great biofuel potential. Plants that can yield between 100-400 tons/acre of low-cost, high-value biomass materials are particularly useful, especially when there is none of the high costs, labor requirements, chemical inputs, or geographic restrictions associated with low biomass plant production.

Monoacylglycerol Acyltransferases

The monoacylglycerol acyltransferase (MGAT) enzyme is associated with mammals, primarily with the intestine in mammals where it catalyzes the synthesis of diacylglycerol (DAG) directly from monoacylglycerol (MAG) and fatty acyl-CoA. In contrast, the primary TAG synthesis pathway found in plants is the Kennedy, or glycerol phosphate pathway (FIG. 1) which does not include a MGAT step. In the Kennedy pathway, DAG is formed from an acylated glycerol backbone in a two-step reaction consisting of an initial acylation by lysophosphatidic acid acyltransferase (LPAAT) which adds a fatty acyl-CoA to a lysophosphatidic acid (LysoPA; LPA) substrate and the subsequent removal of a phosphate group from the product, phosphatidic acid (PA), to yield inorganic phosphate (Pi) and DAG. In contrast, MGAT catalyzes the formation of DAG directly, by acylating a MAG with an acyl group coming from fatty acyl-CoA. Following synthesis of DAG, another enzyme, diacylglycerol acyltransferase (DGAT), acylates DAG to form TAG.

The first MGAT gene to be isolated was from mouse (MGAT1) and this gene coded for a membrane-bound, non-soluble, enzyme (Yen et al., 2002). Other similar MGAT genes have been characterized in animals, including a second MGAT gene from mouse (MGAT2) and three human genes, but no genes encoding MGAT have been confirmed to have been cloned from plants (Cao et al., 2003; Cheng et al., 2003).

Diacylglycerol Acyltransferases

DGAT is an integral membrane protein that catalyzes the final enzymatic step in the production of TAG in plants, fungi and mammals. This enzyme is responsible for transferring an acyl group from acyl-coenzyme A (acyl-CoA) to DAG to form TAG. DGAT is associated with membrane and lipid body fractions in plants and fungi, particularly, in oilseeds where it contributes to the storage of carbon used as energy reserves. DGAT is known to regulate TAG structure and direct TAG synthesis. Furthermore, it is known that the DGAT reaction is specific for lipid synthesis. Overexpression of the acyl-CoA-dependent DGAT in a seed-specific manner in wild type plants results in augmentation of seedoil deposition and average seed weight (Jako et al., 2001).

To maximise yields for the commercial production of lipids, there is a need for further means to increase the levels of lipids, particularly non-polar lipids such as DAGs and TAGs, in transgenic organisms or parts thereof such as plants, seeds, leaves, algae and fungi.

SUMMARY OF THE INVENTION

The present inventors have surprisingly demonstrated that the transgenic expression of a MGAT gene or a related gene results in significant increases in lipid yield in cells such as plant cells. The present inventors have also identified a new pathway for the synthesis of DAG and TAG in transgenic organisms such as plants, which is different to the well-known Kennedy pathway.

Accordingly, the present invention provides a method of producing extracted lipid, the method comprising the steps of:

i) obtaining a transgenic non-human organism or part thereof comprising one or more exogenous polynucleotides, wherein the transgenic non-human organism or part thereof has an increased level of one or more non-polar lipids when compared to a corresponding organism or part thereof lacking the one or more exogenous polynucleotides, and ii) extracting the lipid from the transgenic non-human organism or part thereof,
thereby producing the extracted lipid.

In one embodiment, the total non-polar lipid content of the transgenic non-human organism or part thereof is increased when compared to the corresponding organism or part thereof.

The transgenic non-human organism or part thereof may be further defined by features (i), (ii), (iii), singly or in combination: feature (i) quantifies the extent of the increased level of the one or more non-polar lipids or the total non-polar lipid content, which may be expressed as the extent of increase on a weight basis, or as the relative increase compared to the level in the corresponding non-human organism or part thereof, and/or feature (ii) specifies the plant genus or species, or the fungal or algal species, or other cell type, and feature (iii) specifies the one or more specific lipids that are increased.

For the feature (i), in an embodiment, the extent of the increase of the one or more non-polar lipids is at least 0.5%, at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, or at least 24% (w/w) greater on a weight basis than the corresponding non-human organism or part thereof, preferably to a maximum increase of about 25% (w/w) on a weight basis.

Also for the feature (i), in a preferred embodiment, the total non-polar lipid content of the transgenic non-human organism or part thereof is increased when compared to the corresponding organism or part thereof. In an embodiment, the total lipid content is increased by at least 0.5%, at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, or at least 24% (w/w) greater on a weight basis than the corresponding non-human organism or part thereof, preferably to a maximum increase of about 25% (w/w) on a weight basis.

Further, for the feature (i), in an embodiment, the level of the one or more non-polar lipids and/or the total non-polar lipid content is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 30%, at least 35%, at least 40%, at least 45%, at least 50%, at least 60%, at least 70%, at least 80%, or at least 90% greater on a relative basis than the corresponding non-human organism or part thereof.

Also for the feature (i), the extent of increase in the level of the one or more non-polar lipids and/or the total non-polar lipid content may be at least 2-fold, at least 3-fold, at least 4-fold, at least 5-fold, at least 6-fold, at least 7-fold, at least 8-fold, at least 9-fold, or at least 10-fold, preferably to a maximum of about 12-fold greater on a relative basis than the corresponding non-human organism or part thereof.

For the feature (ii), in an embodiment, the transgenic non-human organism is a plant, alga, or an organism suitable for fermentation such as a yeast or other fungus, preferably an oleaginous yeast or other fungus. The plant may be, for example, a *Brassica* sp., *Gossypium hirsutum*, *Linum usitatissimum*, *Helianthus* sp., *Carthamus tinctorius*, *Glycine max*, *Zea mays*, *Arabidopsis thaliana*, *Sorghum bicolor*, *Sorghum vulgare*, *Avena sativa*, *Trifolium* sp., *Elaesis guineenis*, *Nicotiana benthamiana*, *Hordeum vulgare*, *Lupinus angustifolius*, *Oryza sativa*, *Oryza glaberrima*, *Camelina sativa*, *Miscanthus x giganteus*, or *Miscanthus sinensis*.

For feature (iii), TAG, DAG, TAG and DAG, MAG, polyunsaturated fatty acid (PUFA), or a specific PUFA (such as eicosadienoic acid (EDA), arachidonic acid (ARA), alpha linolenic acid (ALA), stearidonic acid (SDA), eicosatrienoic acid (ETE), eicosatetraenoic acid (ETA), eicosapentaenoic acid (EPA), docosapentaenoic acid (DPA), docosahexaenoic acid (DHA)), or a combination of two of more thereof, is/are increased. The extent of the increase of TAG, DAG, TAG and DAG, MAG, PUFA, or a specific PUFA may be as defined in feature (i) above. In a preferred embodiment, the MAG is 2-MAG. Preferably, DAG and/or TAG, more preferably the total of DAG and TAG, are increased.

In preferred embodiments, the one or more non-polar lipids and/or the total non-polar lipid content is defined by the combination of features (i), (ii) and (iii), or features (i) and (ii), or features (i) and (iii).

In one embodiment, the part is a seed, fruit, tuber, root, or a vegetative part of a plant. The vegetative part of the plant may be an aerial plant part or a green part such as a leaf or stem. In another embodiment, the part is a cell of a multicellular organism. The extent of the increase of the level of the one or more non-polar lipids and/or the total non-polar lipid content of the specific plant part in this embodiment may be as defined in feature (i) above. The plant part for *Brassica* sp., *Gossypium hirsutum*, *Linum usitatissimum*, *Helianthus* sp., *Carthamus tinctorius*, *Oryza sativa*, *Oryza glaberrima*, *Camelina sativa*, *Glycine max*, or *Zea mays* is preferably seed, whereas the preferred part for *Sorghum bicolor*, *Sorghum vulgare*, *Avena sativa*, *Trifolium* sp., *Elaesis guineenis*, *Nicotiana benthamiana*, *Hordeum vulgare*, *Lupinus angustifolius*, *Miscanthus x giganteus*, or *Miscanthus sinensis* is a vegetative part, in particular leaves and stems.

In one embodiment, the part is a plant seed and the extracted lipid is seedoil. The method of the invention may further comprise harvesting the seed from the transgenic plant, pressing the seedoil from the seed, and/or purifying the seedoil in one or more steps. The seed may be, for example, from a canola plant, a corn plant, a soybean plant, a lupin plant, a peanut plant, a sunflower plant, a cotton plant, a safflower plant, or a flax plant.

In one embodiment, the total oil content, or the total fatty acid content, of the seed is at least 0.5% (w/w) to 25% (w/w) greater on a weight basis than a corresponding seed lacking the one or more exogenous polynucleotides.

In one embodiment, the relative DAG content of the seedoil is at least 10%, at least 10.5%, at least 11%, at least 11.5%, at least 12%, at least 12.5%, at least 13%, at least 13.5%, at least 14%, at least 14.5%, at least 15%, at least 15.5%, at least 16%, at least 16.5%, at least 17%, at least 17.5%, at least 18%, at least 18.5%, at least 19%, at least 19.5%, at least 20% (w/w) greater than a corresponding seed. In an embodiment, the DAG content of the seed is increased by an amount as defined in feature (i) and the seed is from a genus and/or species as defined in feature (ii).

In one embodiment, the relative TAG content of the seedoil is at least 5%, at least 5.5%, at least 6%, at least 6.5%, at least 7%, at least 7.5%, at least 8%, at least 8.5%, at least 9%, at least 9.5%, or at least 10% (w/w) greater than a corresponding seed. In an embodiment, the TAG content of the seed is increased by an amount as defined in feature (i) and the seed is from a genus and/or species as defined in feature (ii). In one embodiment, the seed is canola seed having an oil content on a weight basis (w/w) of at least 45%, at least 46%, at least 47%, at least 48%, at least 49%, at least 50%, at least 51%, at least 52%, at least 53%, at least 54%, or at least 55%.

In one embodiment, the seed is corn seed having an oil content on a weight basis (w/w) of at least 5%, at least 6%, at least 7%, at least 8%, at least 9%, or at least 10%.

In one embodiment, the seed is soybean seed having an oil content on a weight basis (w/w) of at least 20%, at least 21%, at least 22%, at least 23%, at least 24%, at least 25%, at least 26%, at least 27%, at least 28%, at least 29%, or at least 30%.

In one embodiment, the seed is lupin seed having an oil content on a weight basis (w/w) of at least 10%, at least 11%, at least 12%, at least 13%, at least 14%, at least 15%, or at least 16%.

In one embodiment, the seed is peanut seed having an oil content on a weight basis (w/w) of at least 50%, at least 51%, at least 52%, at least 53%, at least 54%, or at least 55%.

In one embodiment, the seed is sunflower seed having an oil content on a weight basis (w/w) of at least 50%, at least 51%, at least 52%, at least 53%, at least 54%, or at least 55%.

In one embodiment, the seed is cotton seed having an oil content on a weight basis (w/w) of at least 41%, at least 42%, at least 43%, at least 44%, at least 45%, at least 46%, at least 47%, at least 48%, at least 49%, or at least 50%.

In one embodiment, the seed is safflower seed having an oil content on a weight basis (w/w) of at least 35%, at least 36%, at least 37%, at least 38%, at least 39%, at least 40%, at least 41%, at least 42%, at least 43%, at least 44%, or at least 45%.

In one embodiment, the seed is flax seed having an oil content on a weight basis (w/w) of at least 36%, at least 37%, at least 38%, at least 39%, or at least 40%.

In one embodiment, the seed is *Camelina sativa* seed having an oil content on a weight basis (w/w) of at least 36%, at least 37%, at least 38%, at least 39%, at least 40%, at least 41%, at least 42%, at least 43%, at least 44%, or at least 45%.

In another embodiment, the organism part is a vegetative plant part and the TAG, DAG, TAG and DAG, or MAG content of the vegetative plant part is at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 30% at least 35%, at least 40%, at least 45%, at least 50%, at least 60%, at least 70%, at least 80%, or at least 90% (w/w) greater on a relative basis than the TAG, DAG, TAG and DAG, or MAG content of a corresponding vegetative plant part lacking the one or more exogenous polynucleotides. In a preferred embodiment, the MAG is 2-MAG. In an embodiment, the TAG, DAG, TAG and DAG, or MAG content of the vegetative plant part is determined from the amount of these lipid components in the extractable lipid of the vegetative plant part. In a further embodiment, the TAG, DAG, TAG and DAG, or MAG content of the transgenic vegetative plant part is increased by an amount as defined in feature (i).

In one embodiment, at least 60% (mol %) of the fatty acid content of the total non-polar lipid content of the organism or part thereof, or of the lipid extracted therefrom, is oleic acid.

In another embodiment, the PUFA content of the organism or part thereof is increased when compared to the corresponding organism or part thereof. In this context, the PUFA content includes both esterified PUFA (including TAG, DAG, etc.) and non-esterified PUFA. In an embodiment, the PUFA content of the organism or part thereof is preferably determined from the amount of PUFA in the extractable lipid of the organism or part thereof. The extent of the increase in PUFA content may be as defined in feature (i). The PUFA content may comprise EDA, ARA, ALA, SDA, ETE, ETA, EPA, DPA, DHA, or a combination of two of more thereof.

In another embodiment, the level of a PUFA in the organism or part thereof or the lipid extracted therefrom is increased when compared to the corresponding organism or part thereof, or the lipid extracted therefrom. The PUFA may be EDA, ARA, ALA, SDA, ETE, ETA, EPA, DPA, DHA, or a combination of two of more thereof. The extent of the increase in the PUFA may be as defined in feature (i).

In an embodiment, the level of the one or more non-polar lipids (such as TAG, DAG, TAG and DAG, MAG, PUFA, or a specific PUFA) and/or the total non-polar lipid content is determinable by analysis by using gas chromatography of fatty acid methyl esters obtained from the extracted lipid. Alternate methods for determining any of these contents are known in the art, and include methods which do not require extraction of lipid from the organism or part thereof, for example, analysis by near infrared (NIR) or nuclear magnetic resonance (NMR).

In one embodiment, the one or more exogenous polynucleotides encode:
i) a monoacylglycerol acyltransferase (MGAT),
ii) a diacylglycerol acyltransferase 2 (DGAT2),
iii) a MGAT and a glycerol-3-phosphate acyltransferase (GPAT), or
iv) a MGAT and a DGAT, or
v) a MCAT, a GPAT and a DGAT.

In one embodiment, the exogenous polynucleotide encodes a MGAT that catalyzes the acylation of either sn-1 MAG or sn-2 MAG to form sn-1,3 DAG or sn-1,2/2,3-DAG, respectively. In a preferred embodiment, the MGAT catalyzes the acylation of sn-2 MAG to form sn-1,2/2,3-DAG. The exogenous polynucleotide encoding the MGAT may comprise one or more of:
i) a sequence of nucleotides selected from any one of SEQ ID NOs:1 to 44,
ii) a sequence of nucleotides encoding a polypeptide comprising amino acids having a sequence as provided in any one of SEQ ID NOs:45 to 82, or a biologically active fragment thereof,
iii) a sequence of nucleotides which is at least 50% identical to i) or ii), or
iv) a sequence of nucleotides which hybridizes to any one of i) to iii) under stringent conditions.

In one embodiment, the exogenous polynucleotide encodes a MGAT1, comprising one or more of:
i) a sequence of nucleotides selected from any one of SEQ ID NOs:1, 3 to 5, or 7 to 23,
ii) a sequence of nucleotides encoding a polypeptide comprising amino acids having a sequence as provided in any one of SEQ ID NOs:45 to 61, or a biologically active fragment thereof,
iii) a sequence of nucleotides which is at least 50% identical to i) or ii), or
iv) a sequence of nucleotides which hybridizes to any one of i) to iii) under stringent conditions.

In another embodiment, the exogenous polynucleotide encodes a MGAT2, comprising one or more of:
i) a sequence of nucleotides selected from any one of SEQ ID NOs:2, 6, or 24 to 37,
ii) a sequence of nucleotides encoding a polypeptide comprising amino acids having a sequence as provided in any one of SEQ ID NOs:62 to 75, or a biologically active fragment thereof,
iii) a sequence of nucleotides which is at least 50% identical to i) or ii), or
iv) a sequence of nucleotides which hybridizes to any one of i) to iii) under stringent conditions.

In another embodiment, the exogenous polynucleotide encodes a MGAT3, comprising one or more of:
i) a sequence of nucleotides selected from any one of SEQ ID NOs:38 to 44,
ii) a sequence of nucleotides encoding a polypeptide comprising amino acids having a sequence as provided in any one of SEQ ID NOs:76 to 82, or a biologically active fragment thereof,
iii) a sequence of nucleotides which is at least 50% identical to i) or ii), or
iv) a sequence of nucleotides which hybridizes to any one of i) to iii) under stringent conditions.

In another embodiment, the exogenous polynucleotide encodes a DGAT that catalyzes the acylation of either sn-1,3 DAG or sn-1,2/2,3-DAG, preferably sn-1,2/2,3-DAG to form TAG. In an embodiment, the exogenous polynucleotide encodes a DGAT2 comprising one or more of:
i) a sequence of nucleotides selected from any one of SEQ ID NO:204 to 211,
ii) a sequence of nucleotides encoding a polypeptide comprising amino acids having a sequence as provided in any one of SEQ ID NO:212 to 219, or a biologically active fragment thereof,
iii) a sequence of nucleotides which is at least 50% identical to i) or ii), or
iv) a sequence of nucleotides which hybridizes to any one of i) to iii) under stringent conditions. In a preferred embodiment, the DGAT2 comprises a sequence of nucleotides of SEQ ID NO:204 and/or a sequence of nucleotides encoding a polypeptide comprising amino acids having a sequence as provided in SEQ ID NO:212.

In another embodiment, the exogenous polynucleotide encodes a glycerol-3-phosphate acyltransferase (GPAT). In a preferred embodiment, the GPAT also has phosphatase activity and produces MAG (i.e., a GPAT that acylates G-3-P to form either sn-1 LPA or sn-2 LPA and removes a phosphate group from the LPA to form MAG). In a further preferred embodiment, the GPAT is a sn-2 GPAT (i.e., has preference for producing sn-2 LPA from G-3-P) and has phosphatase activity to produce 2-MAG, for example, *Arabidopsis* GPAT4 or GPAT6. The exogenous polynucleotide encoding the GPAT may comprise one or more of:
i) a sequence of nucleotides selected from any one of SEQ ID NOs:84 to 141,
ii) a sequence of nucleotides encoding a polypeptide comprising amino acids having a sequence as provided in any one of SEQ ID NOs:144 to 201, or a biologically active fragment thereof,
iii) a sequence of nucleotides which is at least 50% identical to i) or ii), or
iv) a sequence of nucleotides which hybridizes to any one of i) to iii) under stringent conditions.

In another or additional embodiment, the exogenous polynucleotide encodes a GPAT having phosphatase activity comprising one or more conserved amino acid sequences as provided in SEQ ID NOs:225, 226, and 227, or a sequence of amino acids which is at least 50%, preferably at least 60%, more preferably at least 65% identical thereto.

In one embodiment, the one or more exogenous polynucleotides encodes a mutant MGAT and/or DGAT and/or GPAT. For example, the one or more exogenous polynucleotides may encode a MGAT and/or DGAT and/or GPAT having a conservative amino acid substitution as exemplified in Table 1 relative to a wildtype MGAT and/or DGAT and/or GPAT.

In one embodiment, the transgenic non-human organism or part thereof comprises a first exogenous polynucleotide that encodes a MOAT and a second exogenous polynucleotide that encodes a GPAT. The first and second polynucleotides may be provided as separate molecules or may be provided as a contiguous single molecule. In a preferred embodiment, the GPAT is a GPAT having phosphatase activity such as an *Arabidopsis* GPAT4 or GPAT6. The GPAT having phosphatase activity acts to catalyze the formation of MAG from G-3-P (i.e., acylates G-3-P to form LPA and subsequently removes a phosphate group to form MAG) in the transgenic non-human organism or part thereof. The MGAT then acts to catalyze the formation of DAG in the transgenic non-human organism or part thereof by acylating the MAG with an acyl group derived from fatty acyl-CoA. The MGAT such as *A. thaliana* MGAT1 may also act to catalyze the formation of TAG in the transgenic non-human organism or part thereof if it also has DGAT activity.

The transgenic non-human organism or part thereof may comprise a third exogenous polynucleotide encoding, for example, a DGAT. The first, second and third polynucleotides may be provided as separate molecules or may be provided as a contiguous single molecule. The DGAT acts to catalyse the formation of TAG in the transgenic non-human organism or part thereof by acylating the DAG (preferably produced by the MGAT pathway) with an acyl group derived from fatty acyl-CoA.

In another embodiment, the transgenic non-human organism or part thereof comprises a first exogenous polynucleotide that encodes a MGAT and a second exogenous polynucleotide that encodes a DGAT. The first and second polynucleotides may be provided as separate molecules or may be provided as a contiguous single molecule. The transgenic non-human may comprise a third exogenous polynucleotide encoding, for example, a GPAT, preferably a GPAT having phosphatase activity such as an *Arabidopsis* GPAT4 or GPAT6. The first, second and third polynucleotides may be provided as separate molecules or may be provided as a contiguous single molecule.

In a further embodiment, the level of the one or more non-polar lipids and or the total non-polar lipid content of the transgenic organism or part thereof is at least 0.5% (w/w) greater on a weight basis and/or at least 1% (w/w) greater on a relative basis than a corresponding organism or part thereof lacking the one or more exogenous polynucleotides but comprising an exogenous polynucleotide encoding an *Arabidopsis thaliana* DGAT1 (SEQ ID NO:83).

In yet a further embodiment, the transgenic non-human organism or part thereof further comprises one or more introduced mutations, and/or an exogenous polynucleotide which down-regulates the production and/or activity of an endogenous enzyme of the transgenic non-human organism or part thereof selected from DGAT, sn-1 GPAT, 1-acyl-glycerol-3-phosphate acyltransferase (LPAAT), acyl-CoA:lysophosphatidylcholine acyltransferase (LPCAT), phosphatidic acid phosphatase (PAP), or a combination of two or more thereof. The sn-1 GPAT may be a GPAT that in its wild-type state has no detectable phosphatase activity, for example, a GPAT1 or GPAT3. The GPAT1 may have an amino acid sequence as provided in SEQ ID NO:202, or a homologue thereof. The GPAT3 may have an amino acid sequence as shown in SEQ ID NO:203, or a homologue thereof.

The exogenous polynucleotide may be, for example, selected from: an antisense polynucleotide, a sense polynucleotide, a catalytic polynucleotide, a microRNA, a polynucleotide which encodes a polypeptide which binds the endogenous enzyme and a double stranded RNA.

In another aspect, the present invention provides a method of producing extracted lipid, the method comprising the steps of:

i) obtaining a transgenic phototrophic organism or part thereof comprising an exogenous monoacylglycerol acyltransferase (MGAT), wherein the transgenic phototrophic organism or part thereof has an increased level of a non-polar lipid when compared to such an organism or part thereof lacking the exogenous MGAT, and ii) extracting the lipid from the transgenic phototrophic organism or part thereof, thereby producing the extracted lipid.

In another aspect, the present invention provides a transgenic non-human organism or part thereof comprising one or more exogenous polynucleotides, wherein the transgenic non-human organism or part thereof has an increased level of one or more non-polar lipids when compared to a corresponding organism or part thereof lacking the one or more exogenous polynucleotides.

In a preferred embodiment, the total lipid content of the transgenic non-human organism or part thereof is increased when compared to the corresponding organism or part thereof. The extent of the increase of the one or more lipids and/or the total non-polar lipid content may be as defined in feature (i). The transgenic non-human organism or part thereof may be as defined in feature (ii). The non-polar lipid may be defined as in feature (iii). The transgenic non-human organism or part thereof may be defined by the combination of features (i), (ii) and (iii), or features (i) and (ii), or features (i) and (iii).

In one embodiment, the level of the one or more non-polar lipids of the transgenic non-human organism or part thereof is at least 0.5% (w/w) greater on a weight basis and/or at least 1% (w/w) greater on a relative basis than the corresponding organism or part thereof, or as further defined in feature (i).

In a further embodiment, the total non-polar lipid content of the transgenic non-human organism or part thereof is at least 0.5% (w/w) greater on a weight basis and/or at least 1% (w/w) greater on a relative basis, than the corresponding non-human organism or part thereof, or as further defined in feature (i).

In one embodiment, the PUFA content of the transgenic non-human organism or part thereof or the lipid extracted therefrom is increased when compared to the corresponding organism or part thereof or the lipid extracted therefrom. The extent of the increase in PUFA content may be as defined in feature (i).

In another embodiment, the level of a PUFA in the transgenic non-human organism or part thereof or the lipid extracted therefrom is increased when compared to the corresponding organism or part thereof or the lipid extracted therefrom. The extent of the increase in the PUFA may be as defined in feature (i).

In a further embodiment, the level of the one or more non-polar lipids and/or the total lipid content of the transgenic organism or part thereof is at least 0.5% (w/w) greater on a weight basis and/or at least 1% (w/w) greater on a relative basis than a corresponding organism or part thereof lacking the one or more exogenous polynucleotides but comprising an exogenous polynucleotide encoding an *Arabidopsis thaliana* DGAT1.

In one embodiment, the transgenic non-human organism is a plant, alga, or an organism suitable for fermentation such as a yeast or fungus. The plant may be as defined in feature (ii).

The present invention also provides a transgenic non-human organism comprising one or more exogenous polynucleotides encoding:

i) a MOAT,
ii) a DGAT2
iii) a MGAT and a GPAT iv) a MGAT and a DGAT, or
v) a MGAT, a GPAT and a DGAT.

The transgenic non-human organism may be further characterised by one or more features defined herein. The one or more exogenous polynucleotides may comprise a sequence as defined above.

In another aspect, the present invention provides a method of obtaining a cell with enhanced ability to produce one or more non-polar lipids, the method comprising i) introducing into a cell one or more exogenous polynucleotides encoding
a) a MGAT,
b) a DGAT2
c) a MGAT and a GPAT
d) a MGAT and a DGAT, or
e) a MGAT, a GPAT and a DGAT.
wherein the one or more exogenous polynucleotides are operably linked to one or more promoters that are capable of directing expression of the one or more exogenous polynucleotides in the cell, ii) expressing the one or more exogenous polynucleotides in the cell, iii) analysing the lipid content of the cell, and iv) selecting a cell having an increased level of one or more non-polar lipids when compared to a corresponding cell lacking the exogenous polynucleotides.

In a preferred embodiment, the total lipid content of the selected cell is increased when compared to the corresponding cell.

In one embodiment, the one or more non-polar lipids and/or a total non-polar lipid content of the selected cell is at least 0.5% (w/w) greater on a weight basis and/or at least 1% (w/w) greater on a relative basis than the corresponding cell, or as further defined in feature (i).

In another embodiment, the PUFA content of the selected cell is increased when compared to the corresponding cell. The extent of the increase in PUFA content may be as defined in feature (i).

In another embodiment, the level of a PUFA in the selected cell is increased when compared to the corresponding cell. The extent of the increase in the PUFA may be as defined in feature (i).

The one or more exogenous polynucleotides in this aspect may comprise a sequence as defined above. Further, the one or more exogenous polynucleotides may not be known prior to the method to encode a MGAT, a DGAT2, a MGAT and a GPAT, a MGAT and a DGAT, or a MGAT, a GPAT and a DGAT, but rather may be candidates therefor. The method therefore may be used as an assay to identify or select polynucleotides encoding a MGAT, a DGAT2, a MGAT and a GPAT (preferably a GPAT also having phosphatase activity), a MGAT and a DGAT, or a MGAT, a GPAT (preferably a GPAT also having phosphatase activity) and a DGAT.

Expression of GPAT may result in an increase in MAG levels in the cell if the GPAT also has phosphatase activity, expression of a MGAT may result in an increase in DAG levels in the cell, whilst expression of a DGAT may result in an increase in TAG levels in the cell. Expression of a MGAT may also result in an increase in TAG levels in the cell, if the MGAT also has DGAT activity. Expression of a MGAT and a DGAT may result in an increase in DAG and/or TAG levels in the cell. Expression of a MGAT and a GPAT may result in an increase in MAG (if the GPAT also has phosphatase activity) and/or DAG levels in the cell. Expression of a MGAT and a GPAT may also result in an increase in TAG levels in the cell, if the MGAT also has DGAT activity. Expression of a MGAT, a GPAT and a DGAT may result in an increase in MAG (if the GPAT also has phosphatase activity) and/or DAG and/or TAG levels in the cell.

In one embodiment, the selected cell is a cell according to the invention.

In one embodiment, the exogenous polynucleotides are stably integrated into the genome of the cell.

The method may further comprise the steps of regenerating a transgenic organism from the cell and/or obtaining progeny from the cell, for example obtaining seed, which steps may occur at any point after step i).

In an alternative embodiment, the exogenous polynucleotides are expressed transiently in the cell.

In another aspect, the present invention provides a transgenic cell or plant obtained using the method of the invention, or progeny thereof.

In another aspect, the present invention provides use of one or more exogenous polynucleotides encoding
i) a MGAT,
ii) a DGAT2
iii) a MGAT and a GPAT
iv) a MGAT and a DGAT, or
v) a MGAT, a GPAT and a DGAT,
for producing a transgenic non-human organism or part thereof with enhanced ability to produce one or more non-polar lipids when compared to a corresponding organism or part thereof lacking the one or more exogenous polynucleotides. The extent of the enhanced ability may be as defined in feature (i). The transgenic non-human organism or part thereof may be defined as in feature (ii), or may be defined by the combination of features (i), (ii) and (iii), or features (i) and (ii), or features (i) and (iii). The one or more exogenous polynucleotides may comprise a sequence as defined above.

In another aspect, the present invention provides a transgenic seed of a plant, the seed comprising one or more exogenous polynucleotides and having an increased level of one or more non-polar lipids and/or total non-polar lipid content when compared to a corresponding seed lacking the exogenous polynucleotides. The extent of the increase may be as defined in feature (i). The transgenic seed may be from a genus and/or species as defined in feature (ii). The transgenic seed may be defined by the combination of features (i), (ii) and (iii), or features (i) and (ii), or features (i) and (iii). The one or more exogenous polynucleotides may comprise a sequence as defined above.

In another aspect, the present invention provides a transgenic plant which produces a seed of the invention. The transgenic plant may be, for example, a *Brassica* sp., *Gossypium hirsutum*, *Linum usitatissimum*, *Helianthus* sp., *Carthamus tinctorius*, *Glycine max*, *Zea mays*, *Arabidopsis thaliana*, *Sorghum bicolor*, *Sorghum vulgare*, *Avena saliva*, *Trifolium* sp., *Elaesis guineenis*, *Nicotiana benthamiana*, *Hordeum vulgare*, *Lupinus angustifolius*, *Oryza saliva*, *Oryza glaberrima*, *Camelina saliva*, *Miscanthus x giganteus*, or *Miscanthus sinensis*.

In another aspect, the present invention provides a method of producing seed, the method comprising:
i) growing a transgenic plant of the invention, and
ii) harvesting the seed.

In another aspect, the present invention provides a fermentation process comprising the steps of:
i) providing a vessel containing a liquid composition comprising a transgenic non-human organism of the invention, which is suitable for fermentation, and constituents required for fermentation and fatty acid biosynthesis, and
ii) providing conditions conducive to the fermentation of the liquid composition contained in said vessel.

In another aspect, the present invention provides extracted lipid obtainable from a method of the invention, a transgenic non-human organism of the invention, a transgenic cell of the invention, a transgenic plant of the invention, or a transgenic seed of the invention. The extractable lipid may have an enhanced TAG content, DAG content, TAG and DAG content, MAG content, PUFA content, or specific PUFA content, and/or total non-polar lipid content. In a preferred embodiment, the MAG is 2-MAG. The extent of the increased TAG content, DAG content, TAG and DAG content, MAG content, PUFA content, specific PUFA content, and/or total non-polar lipid content may be as defined in feature (i).

The present invention also provides an extracted lipid comprising a DAG content that is at least 1% (w/w), or at least 2% (w/w), on a weight basis of the total extracted lipid. Preferably, the extracted lipid also comprises MAG at detectable levels. In one embodiment, the extracted lipid is canola, corn, soybean, lupin, peanut, sunflower, cotton, safflower, or flax oil. The lipid may comprise eruric acid, cyclopropenoid fatty acids (CPFA), and/or glucosinolates at detectable levels.

The present invention also provides use of a transgenic non-human organism or part thereof of the invention, a transgenic cell of the invention, a transgenic plant of the invention, a transgenic seed of the invention, or an extracted lipid of the invention for the manufacture of an industrial product. The industrial product may be, for example, fuel. The fuel may comprise a minimum level of the extracted lipid according to the invention such as at least 10%, at least 20%, or at least 30% (w/w).

In another aspect, the present invention provides a method of producing fuel, the method comprising:
i) reacting a lipid of the invention with an alcohol, optionally, in the presence of a catalyst, to produce alkyl esters, and
ii) optionally, blending the alkyl esters with petroleum based fuel.

In one embodiment, the alkyl esters are methyl esters. The fuel produced by the method may comprise a minimum level of the lipid of the invention such as at least 10%, at least 20%, or at least 30% (w/w).

In another aspect, the present invention provides a method of producing a feedstuff, the method comprising admixing a transgenic non-human organism or part thereof of the invention, a transgenic cell of the invention, a transgenic plant of the invention, a transgenic seed of the invention, or an extracted lipid of the invention, or an extract or portion thereof, with at least one other food ingredient.

In another aspect, the present invention provides feedstuffs, cosmetics or chemicals comprising a transgenic non-human organism or part thereof of the invention, a transgenic cell of the invention, a transgenic plant of the invention, a transgenic seed of the invention, or an extracted lipid of the invention, or an extract or portion thereof.

In another aspect, the present invention provides a method for identifying a nucleic acid molecule encoding an acyltransferase having an increased ability to produce MAG, DAG and/or TAG in a cell, the method comprising:
i) obtaining a cell comprising a nucleic acid molecule operably linked to a promoter which is active in the cell, wherein the nucleic acid molecule comprises a sequence of nucleotides as defined herein and/or a sequence of nucleotides encoding a polypeptide having one or more amino acid sequences as provided in SEQ ID NOs:220, 221, 222, 223, 224, 225, 226 and 227, or a sequence of amino acids which is at least 50%, preferably at least 60%, more preferably at least 65% identical thereto, ii) determining if the level of MAG, DAG and/or TAG produced in the cell is increased when compared to a corresponding cell lacking the nucleic acid, and iii) identifying a nucleic acid molecule encoding a acyltransferase having an increased ability to produce MAG, DAG and/or TAG in the cell.

In one embodiment, the nucleic acid molecule comprises a sequence of nucleotides encoding one or more conserved DGAT2 and/or MGAT1/2 amino acid sequences as provided in SEQ ID NOs:220, 221, 222, 223, and 224. In a preferred embodiment, the nucleic acid molecule comprises a sequence of nucleotides encoding the conserved amino acid sequences provided in SEQ ID NO:220 and/or SEQ ID NO:224. In another or additional embodiment, the nucleic acid molecule comprises a sequence of nucleotides encoding one or more conserved GPAT amino acid sequences as provided in SEQ ID NOs:225, 226, and 227, or a sequence of amino acids which is at least 50%, preferably at least 60%, more preferably at least 65% identical thereto.

In one embodiment, the method is for identifying a MCAT having an increased ability to produce DAG and/or TAG.

In another embodiment, the method is for identifying a GPAT having phosphatase activity and an increased ability to produce MAG. In a preferred embodiment, the method is for identifying a sn-2 GPAT having phosphatase activity and an increased ability to produce 2-MAG.

In another embodiment, the method is for identifying a MGAT and a GPAT that together have an increased ability to produce MAG and/or DAG and/or TAG, preferably TAG. In a preferred embodiment, the method is for identifying a sn-2 GPAT having phosphatase activity to produce 2-MAG and together with the MGAT, an increased ability to produce sn-1,2/2,3 DAG and/or TAG.

In another embodiment, the method is for identifying a DGAT having an increseased ability to produce TAG.

In another embodiment, the method is for identifying a MGAT and a DGAT together have an increased ability to produce DAG and/or TAG, preferably TAG.

In another embodiment, the method is for identifying a MGAT, a GPAT and a DGAT that together have an increased ability to produce MAG and/or DAG and/or TAG, preferably TAG. In a preferred embodiment, the GPAT has phosphatase activity to produce MAG. In a further preferred embodiment, the GPAT is a sn-2 GPAT having phosphatase activity to produce 2-MAG.

In one embodiment, the method further comprises introducing the nucleic acid molecule into a cell prior to step i).

In another embodiment, the method further comprises the step of regenerating a transgenic plant from the cell of step i) and optionally, obtaining seed from the transgenic plant. In one embodiment, the cell is a plant cell. The extent of the increased ability to produce MAG and/or DAG and/or TAG may be as defined in feature (i). In a preferred embodiment, the MAG is 2-MAG. The cell may be from a genus and/or species as defined in feature (ii). The cell may be defined by the combination of features (i), (ii) and (iii), or features (i) and (ii), or features (i) and (iii).

In another embodiment, the MGAT and/or GPAT and/or DGAT increases TAG production in the cell by a greater amount than *Arabidopsis thaliana* DGAT1 (SEQ ID NO:83).

In another aspect, the present invention provides an isolated and/or recombinant polynucleotide comprising:

i) a sequence of nucleotides selected from any one of SEQ ID NOs:1 to 6, or ii) a sequence of nucleotides which is at least 80% identical to i).

In another aspect, the invention provides a vector comprising a polynucleotide of the invention.

In another aspect, the invention provides a transgenic cell comprising a polynucleotide of the invention or a vector of the invention.

In another aspect, the invention provides a transgenic non-human organism or part thereof comprising a polynucleotide of the invention, a vector of the invention, or a transgenic cell of the invention. In one embodiment, the transgenic organism is a plant, alga, or an organism suitable for fermentation such as a yeast or fungus. In another embodiment, the part is a seed, fruit, tuber, root, or a vegetative part of a plant.

It will be appreciated by persons skilled in the art that numerous variations and/or modifications may be made to the invention as shown in the specific embodiments without departing from the scope of the invention as broadly described.

The present embodiments are, therefore, to be considered in all respects as illustrative and not restrictive. Each embodiment described herein is to be applied mutatis mutandis to each and every other embodiment unless specifically stated otherwise.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

The term "and/or", e.g., "X and/or Y" shall be understood to mean either "X and Y" or "X or Y" and shall be taken to provide explicit support for both meanings or for either meaning.

BRIEF DESCRIPTION OF THE ACCOMPANYING DRAWINGS

FIG. 1. A representation of various lipid synthesis pathways, most of which converge at DAG, a central molecule in lipid synthesis. This model includes one possible route to the formation of sn-2 MAG which could be used by a bi-functional MGAT/DGAT for DAG formation from glycerol-3-phosphate (G-3-P). Abbreviations are as follows:

G-3-P; glycerol-3-phosphate
LysoPA; lysophosphatidic acid
PA; phosphatidic acid
MAG; monoacylglycerol
DAG; diacylglycerol
TAG; triacylglycerol
Acyl-CoA and FA-CoA; acyl-coenzyme A and fatty acyl-coenzyme A
PC; phosphatidylcholine
GPAT; glycerol-3-phosphate acyltransferase; glycerol-3-phosphate O-acyltransferase; acyl-CoA:sn-glycerol-3-phosphate 1-O-acyltransferase; EC 2.3.1.15
GPAT4; glycerol-3-phosphate acyltransferase 4
GPAT6; glycerol-3-phosphate acyltransferase 6
LPAAT; 1-acyl-glycerol-3-phosphate acyltransferase; 1-acylglycerol-3-phosphate O-acyltransferase; acyl-CoA:1-acyl-sn-glycerol-3-phosphate 2-O-acyltransferase; EC 2.3.1.51
PAP; phosphatidic acid phosphatase; phosphatidate phosphatase; phosphatic acid phosphohydrolase; phosphatidic acid phosphatase; EC 3.1.3.4

MOAT; an acyltransferase having monoacylglycerol acyltransferase (MGAT; 2-acylglycerol O-acyltransferase acyl-CoA:2-acylglycerol O-acyltransferase; EC 2.3.1.22) activity M/DGAT; an acyltransferase having monoacylglycerol acyltransferase (MGAT; 2-acylglycerol O-acyltransferase; acyl-CoA:2-acylglycerol O-acyltransferase; EC 2.3.1.22) and/or diacylglycerol acyltransferase (DGAT; diacylglycerol O-acyltransferase; acyl-CoA:1,2-diacyl-sn-glycerol O-acyltransferase; EC 2.3.1.20) activity LPCAT; acyl-CoA:lysophosphatidylcholine acyltransferase; 1-acylglycerophosphocholine O-acyltransferase; acyl-CoA:1-acyl-sn-glycero-3-phosphocholine O-acyltransferase; EC 2.3.1.23

PLD-Z; Phospholipase D zeta; choline phosphatase; lecithinase D; lipophosphodiesterase II; EC 3.1.4.4

CPT; CDP-choline:diacylglycerol cholinephosphotransferase; 1-alkyl-2-acetylglycerol cholinephosphotransferase; alkylacylglycerol cholinephosphotransferase; cholinephosphotransferase; phosphorylcholine-glyceride transferase; EC 2.7.8.2

PDCT; phosphatidylcholine:diacylglycerol cholinephosphotransferase

PLC; phospholipase C; EC 3.1.4.3

PDAT; phospholipid:diacylglycerol acyltransferase; phospholipid:1,2-diacyl-sn-glycerol O-acyltransferase; EC 2.3.1.158

Pi; inorganic phosphate

Figure 2:
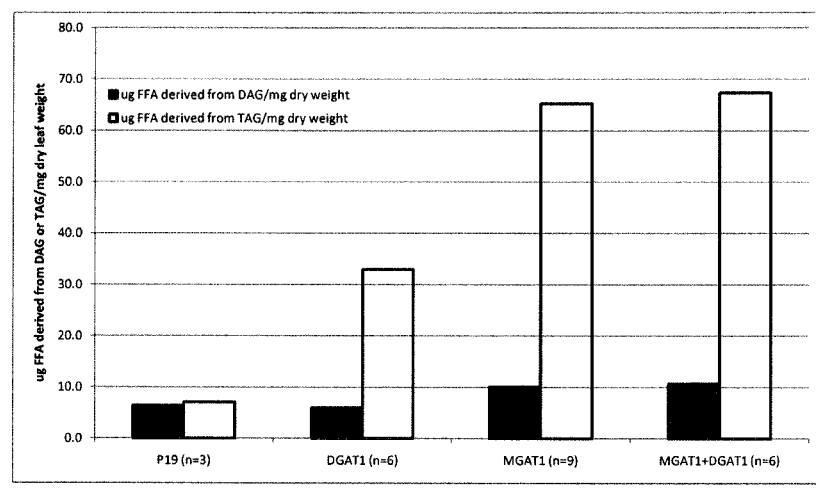

FIG. 2. Relative DAG and TAG increases in *Nicotiana benthamiana* leaf tissue transformed with constructs encoding p19 (negative control), *Arabidopsis thaliana* DGAT1, *Mus musculus* MGAT1 and a combination of DGAT1 and MGAT1, each expressed from the 35S promoter. The MGAT1 enzyme was far more active than the DGAT1 enzyme in promoting both DAG and TAG accumulation in leaf tissue. Expression of the MGAT1 gene resulted in twice as much DAG and TAG accumulation in leaf tissue compared to expression of DGAT1 alone.

Figure 3:
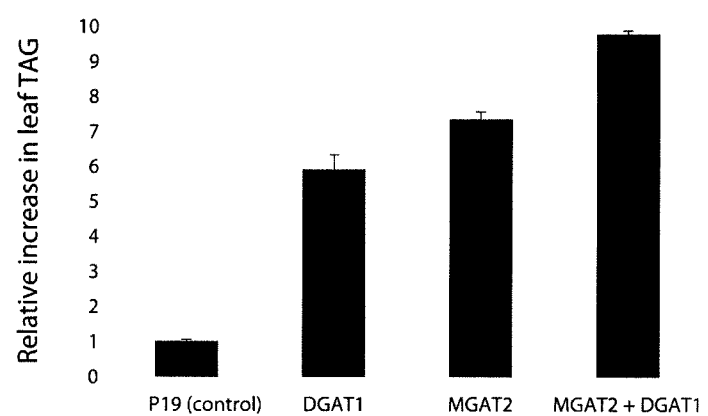

FIG. 3. Relative TAG increases in *N. benthamiana* leaf transformed with constructs encoding p19 (negative control), *A. thaliana* DGAT1, *M. musculus* MGAT2 and a combination of MGAT2 and DGAT1. Error bars denote standard error of triplicate samples.

Figure 4:
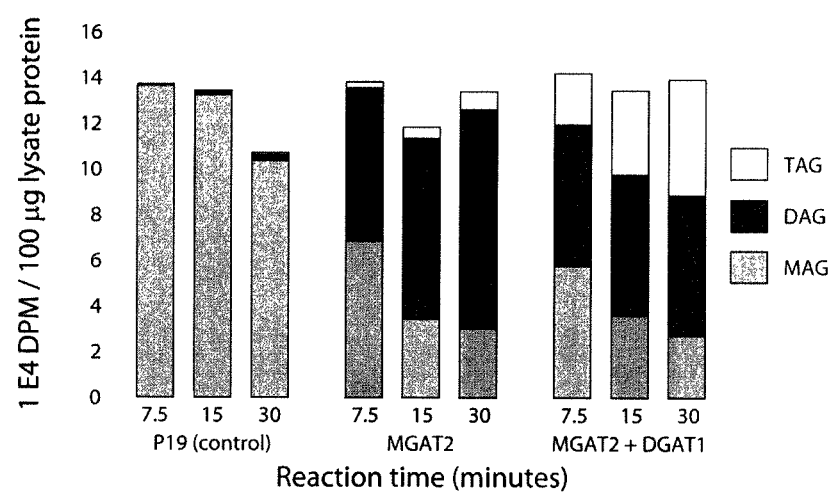

FIG. 4. Radioactivity (DPM) in MAG, DAG and TAG fractions isolated from transiently-transformed *N. benthamiana* leaf lysates fed with sn-2-MAG[$^{14}$C] and unlabelled oleic acid over a time-course. The constructs used were as for FIG. 3.

Figure 5:
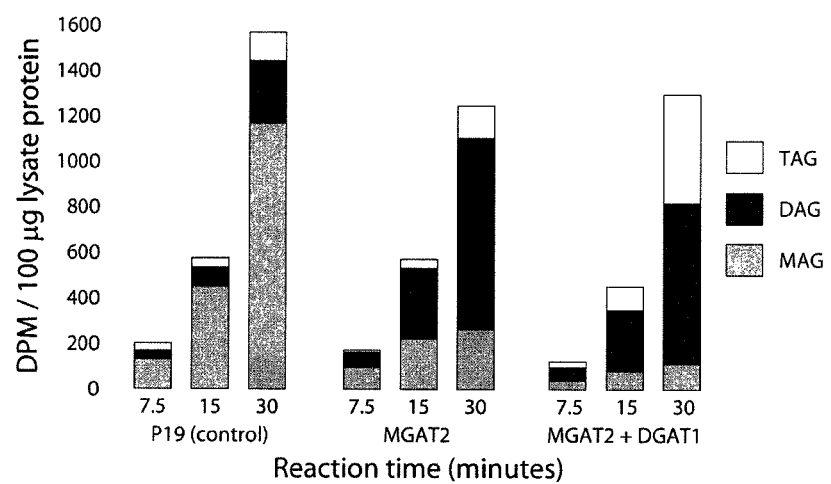

FIG. 5. As for FIG. 4 but fed [$^{14}$C]G-3-P and unlabelled oleic acid.

Figure 6:
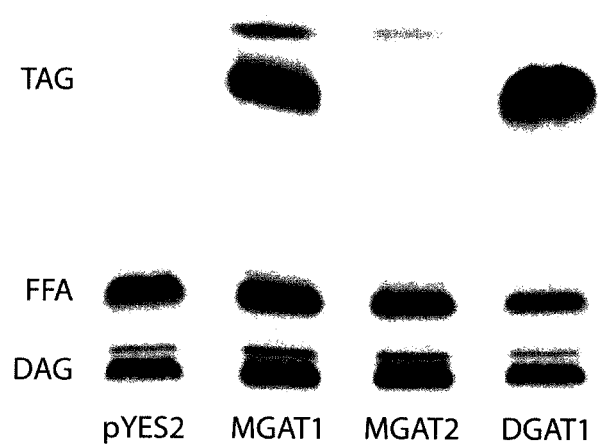

FIG. 6. Autoradiogram of TLC plate showing TAG-formation by *A. thaliana* DGAT1 and *M. musculus* MGAT1 but not *M. musculus* MGAT2 in yeast assays. The assay is described in Example 5

KEY TO THE SEQUENCE LISTING

SEQ ID NO:1 *Mus musculus* codon optimised MGAT1
SEQ ID NO:2 *Mus musculus* codon optimised MGAT2
SEQ ID NO:3 *Ciona intestinalis* codon optimised predicted MGAT1
SEQ ID NO:4 *Tribolium castaneum* codon optimised predicted MGAT1
SEQ ID NO:5 *Danio rerio* codon optimised MGAT1
SEQ ID NO:6 *Danio rerio* codon optimised MGAT2
SEQ ID NO:7 *Mus musculus* MGAT1 polynucleotide 84162)
SEQ ID NO:8 *Homo sapiens* MGAT1 polynucleotide (AF384163)
SEQ ID NO:9 Pan troglodytes predicted MGAT1 polynucleotide transcript variant (XM_001166055)
SEQ ID NO:10 Pan troglodytes predicted MGAT1 polynucleotide transcript variant 2 (XM_0526044.2)
SEQ ID NO:11 *Canis familiaris* predicted MGAT1 polynucleotide (XM_545667.2)
SEQ ID NO:12 *Bos taurus* MGAT1 polynucleotide (NM_001001153.2)
SEQ ID NO:13 *Rattus norvegicus* MGAT1 polynucleotide (NM_001108803.1)
SEQ ID NO:14 Danio rerio MGAT1 polynucleotide (NM_001122623.1)
SEQ ID NO:15 *Caenorhabditis elegans* predicted MGAT1 polynucleotide (NM_073012.4)
SEQ ID NO:16 *Caenorhabditis elegans* predicted MGAT1 polynucleotide (NM_182380.5)
SEQ ID NO:17 *Caenorhabditis elegans* predicted MGAT1 polynucleotide (NM_065258.3)
SEQ ID NO:18 *Caenorhabditis elegans* Predicted Mgat1 Polynucleotide (NM_075068.3)
SEQ ID NO:19 *Caenorhabditis elegans* predicted MGAT1 polynucleotide (NM_072248.3)
SEQ ID NO:20 *Kluyveromyces lactis* predicted MGAT1 polynucleotide (XM_455588.1)
SEQ ID NO:21 *Ashbya gossypii* predicted MGAT1 polynucleotide (NM_208895.1)
SEQ ID NO:22 *Magnaporthe oryzae* predicted MGAT1 polynucleotide (XM_368741.1)
SEQ ID NO:23 *Ciona intestinalis* predicted MGAT1 polynucleotide (XM_002120843.1)
SEQ ID NO:24 *Mus musculus* MGAT2 polynucleotide (AY157609)
SEQ ID NO:25 *Homo sapiens* MGAT2 polynucleotide (AY157608)
SEQ ID NO:26 *Pan troglodytes* predicted MGAT2 polynucleotide (XM_522112.2)
SEQ ID NO:27 *Canis familiaris* predicted MGAT2 polynucleotide (XM_542304.1)
SEQ ID NO:28 *Bos taurus* MGAT2 polynucleotide (NM_001099136.1)
SEQ ID NO:29 *Rattus norvegicus* MGAT2 polynucleotide (NM_001109436.2)
SEQ ID NO:30 *Gallus gallus* predicted MGAT2 polynucleotide (XM_424082.2)
SEQ ID NO:31 *Danio rerio* MGAT2 polynucleotide (NM_001006083.1)
SEQ ID NO:32 *Drosophila melanogaster* MGAT2 polynucleotide (NM_136474.2)
SEQ ID NO:33 *Drosophila melanogaster* MGAT2 polynucleotide (NM_136473.2)
SEQ ID NO:34 *Drosophila melanogaster* MGAT2 polynucleotide (NM_136475.2)
SEQ ID NO:35 *Anopheles gambiae* MGAT2 polynucleotide (XM_001688709.1)
SEQ ID NO:36 *Anopheles gambiae* MGAT2 polynucleotide (XM_315985)
SEQ ID NO:37 *Tribolium castaneum* predicted MGAT2 polynucleotide (XM_970053.1)
SEQ ID NO:38 *Homo sapiens* Mgat3 Polynucleotide (AY229854)
SEQ ID NO:39 Pan troglodytes predicted MGAT3 polynucleotide transcript variant 1 (XM_001154107.1)
SEQ ID NO:40 Pan troglodytes predicted MGAT3 polynucleotide transcript variant 2 (XM_001154171.1)

SEQ ID NO:41 Pan troglodytes predicted MGAT3 polynucleotide transcript variant 3 (XM_527842.2)
SEQ ID NO:42 Canis familiaris predicted MGAT3 polynucleotide (XM_845212.1)
SEQ ID NO:43 Bos taurus predicted MGAT3 polynucleotide (XM_870406.4)
SEQ ID NO:44 Dania rerio predicted MGAT3 polynucleotide (XM_688413.4)
SEQ ID NO:45 Mus musculus MGAT1 polypeptide (AAK84177.1)
SEQ ID NO:46 Homo sapiens MGAT1 polypeptide (AAK84178.1)
SEQ ID NO:47 Pan troglodytes predicted MGAT1 polypeptide isoform 1 (XP_001166055.1)
SEQ ID NO:48 Pan troglodytes predicted MGAT1 polypeptide isoform 2 (XP_526044.2)
SEQ ID NO:49 Canis familiaris predicted MGAT1 polypeptide (XP_545667.2)
SEQ ID NO:50 Bos taurus MGAT1 polypeptide (NP_001001153.1)
SEQ ID NO:51 Rattus norvegicus MGAT1 polypeptide (NP_001102273.1)
SEQ ID NO:52 Danio rerio MGAT1 polypeptide (NP_001116095.1)
SEQ ID NO:53 Caenorhabditis elegans predicted MGAT1 polypeptide (NP_505413.1)
SEQ ID NO:54 Caenorhabditis elegans Predicted Mgat1 Polypeptide (NP_872180.1)
SEQ ID NO:55 Caenorhabditis elegans predicted MGAT1 polypeptide (NP_497659.1)
SEQ ID NO:56 Caenorhabditis elegans predicted MGAT1 polypeptide (NP_507469.1)
SEQ ID NO:57 Caenorhabditis elegans predicted MGAT1 polypeptide (NP_504649.1)
SEQ ID NO:58 Kluyveromyces lactis predicted MGAT1 polypeptide (XP_455588.1)
SEQ ID NO:59 Ashbya gossypii predicted MGAT1 polypeptide (NP_983542.1)
SEQ ID NO:60 Magnaporthe oryzae predicted MGAT1 polypeptide (XP_368741.1)
SEQ ID NO:61 Ciona intestinalis predicted MGAT1 polypeptide (XP_002120879)
SEQ ID NO:62 Mus musculus MGAT2 polypeptide (AAO23673.1)
SEQ ID NO:63 Homo sapiens MGAT2 polypeptide (AAO23672.1)
SEQ ID NO:64 Pan troglodytes predicted MGAT2 polypeptide (XP_522112.2)
SEQ ID NO:65 Canis familiaris predicted MGAT2 polypeptide (XP_542304.1)
SEQ ID NO:66 Bos taurus MGAT2 polypeptide (NP_001092606.1)
SEQ ID NO:67 Rattus norvegicus MGAT2 polypeptide (NP_001102906.2)
SEQ ID NO:68 Gallus gallus predicted MGAT2 polypeptide (XP_424082.2)
SEQ ID NO:69 Danio rerio MGAT2 polypeptide (NP_001006083.1)
SEQ ID NO:70 Drosophila melanogaster MGAT2 polypeptide (NP_610318.1)
SEQ ID NO:71 Drosophila melanogaster MGAT2 polypeptide (NP_610317.1)
SEQ ID NO:72 Drosophila melanogaster MGAT2 polypeptide (NP_610319.2)
SEQ ID NO:73 Anopheles gambiae MGAT2 polypeptide (XP_001688761)
SEQ ID NO:74 Anopheles gambiae MGAT2 polypeptide (XP_315985.3)
SEQ ID NO:75 Tribolium castaneum predicted MGAT2 polypeptide (XP_975146)
SEQ ID NO:76 Homo sapiens MGAT3 polypeptide (AAO63579.1)
SEQ ID NO:77 Pan troglodytes predicted MGAT3 polypeptide isoform 1 (XP_001154107.1)
SEQ ID NO:78 Pan troglodytes predicted MGAT3 polypeptide isoform 2 (XP_001154171.1)
SEQ ID NO:79 Pan troglodytes predicted MGAT3 isoform 3 (XP_527842.2)
SEQ ID NO:80 Canis familiaris predicted MGAT3 polypeptide (XP_850305.1)
SEQ ID NO:81 Bos taurus predicted MGAT3 polypeptide (XP_875499.3)
SEQ ID NO:82 Danio rerio predicted MGAT3 polypeptide (XP_693505.1)
SEQ ID NO:83 Arabidopsis thaliana DGAT1 polypeptide (CAB44774.1)
SEQ ID NO:84 Arabidopsis thaliana GPAT4 polynucleotide (NM_100043.4)
SEQ ID NO:85 Arabidopsis thaliana GPAT6 polynucleotide (NM_129367.3)
SEQ ID NO:86 Arabidopsis thaliana BAC F5I10 polynucleotide (AF195115.1)
SEQ ID NO:87 Arabidopsis thaliana unknown protein polynucleotide (AY062466.1)
SEQ ID NO:88 Oryza sativa chromosome 3 polynucleotide (AC118133.4)
SEQ ID NO:89 Picea sitchensis clone WS0276_F13 polynucleotide (EF086095.1)
SEQ ID NO:90 Zea mays clone ZM_BFc0110A1 polynucleotide (BT067649.1)
SEQ ID NO:91 Arabidopsis thaliana clone RAFL16-19-H05 polynucleotide (AK228870.1)
SEQ ID NO:92 Oryza sativa clone J065058J01 polynucleotide (AK241033.1)
SEQ ID NO:93 Oryza sativa chromosome 2 polynucleotide (CM000127.1)
SEQ ID NO:94 Oryza sativa chromosome 5 polynucleotide (CM000130.1)
SEQ ID NO:95 Oryza sativa chromosome 2 polynucleotide (CM000139.1)
SEQ ID NO:96 Oryza sativa chromosome 1 polynucleotide (CM000126.1)
SEQ ID NO:97 Oryza saliva chromosome 3 polynucleotide (CM000128.1)
SEQ ID NO:98 Oryza sativa chromosome 3 polynucleotide (CM000140.1)
SEQ ID NO:99 Selaginella moellendorffii SELMOscaffold_102 polynucleotide (GL377667.1)
SEQ ID NO:100 Selaginella moellendorffii SELMOscaffold_102 polynucleotide (GL377667.1)
SEQ ID NO:101 Selaginella Moellendorffii Selmoscaffold_83 Polynucleotide (GL377648.1)
SEQ ID NO:102 Selaginella moellendorffii SELMOscaffold_57 polynucleotide (GL377622.1)
SEQ ID NO:103 Selaginella moellendorffii SELMOscaffold_25 polynucleotide (GL377590.1)
SEQ ID NO:104 Selaginella moellendorffii SELMOscaffold_11 polynucleotide (GL377576.1)
SEQ ID NO:105 Selaginella moellendorffii SELMOscaffold_11 polynucleotide (GL377576.1)
SEQ ID NO:106 Oryza Sativa Os01g0855000 Polynucleotide (Nm_001051374.2)

SEQ ID NO:107 *Oryza sativa* Os02g0114400 polynucleotide (NM_001052203.1)
SEQ ID NO:108: *Zea mays* GPAT8 polynucleotide (NM_001153970.1)
SEQ ID NO:109: *Zea mays* LOC100282930 polynucleotide (NM_001155835.1)
SEQ ID NO:110: *Zea mays* LOC100382119 polynucleotide (NM_001174880.1)
SEQ ID NO:111 *Arabidopsis thaliana* GPAT6 polynucleotide (NM_129367.3)
SEQ ID NO:112 *Arabidopsis thaliana* GPAT8 polynucleotide (NM_116264.5)
SEQ ID NO:113 *Physcomitrella patens* predicted protein (PHYPADRAFT_128739) polynucleotide (XM_001764949.1)
SEQ ID NO:114 *Physcomitrella patens* predicted protein (PHYPADRAFT_83824) polynucleotide (XM_001769619.1)
SEQ ID NO:115 *Physcomitrella patens* predicted protein (PHYPADRAFT_188308) polynucleotide (XM_001769672.1)
SEQ ID NO:116 *Physcomitrella patens* predicted protein (PHYPADRAFT_189499) polynucleotide (XM_001771134.1)
SEQ ID NO:117 *Physcomitrella patens* predicted protein (PHYPADRAFT_95487) polynucleotide (XM_001780481.1)
SEQ ID NO:118 *Vitis Vinifera* predicted protein LOC100243321 polynucleotide (XM_002268477.1)
SEQ ID NO:119 *Vitis Vinifera* predicted protein LOC100243093 polynucleotide (XM_002275312.1)
SEQ ID NO:120 *Vitis Vinifera* predicted protein LOC100259433 polynucleotide (XM_002275996.1)
SEQ ID NO:121 *Vitis Vinifera* predicted protein LOC100264832 polynucleotide (XM_002279055.1)
SEQ ID NO:122 *Populus trichocarpa* predicted protein polynucleotide (XM_002309088.1)
SEQ ID NO:123 *Populus Trichocarpa* Predicted Protein Polynucleotide (XM_002309240.1)
SEQ ID NO:124 *Populus Trichocarpa* Predicted Protein Polynucleotide (XM_002322716.1)
SEQ ID NO:125 *Populus Trichocarpa* Predicted Protein Polynucleotide (XM_002323527.1)
SEQ ID NO:126 *Sorghum bicolor* protein polynucleotide (XM_002439842.1)
SEQ ID NO:127 *Sorghum bicolor* protein polynucleotide (XM_002458741.1)
SEQ ID NO:128 *Sorghum bicolor* protein polynucleotide (XM_002463871.1)
SEQ ID NO:129 *Sorghum bicolor* protein polynucleotide (XM_002464585.1)
SEQ ID NO:130 *Ricinus communis* ER glycerol-phosphate acyltransferase polynucleotide (XM_002511827.1)
SEQ ID NO:131 *Ricinus communis* ER glycerol-phosphate acyltransferase polynucleotide (XM_002517392.1)
SEQ ID NO:132 *Ricinus communis* ER glycerol-phosphate acyltransferase polynucleotide (XM_002520125.1)
SEQ ID NO:133 *Arabidopsis lyrata* phospholipid/glycerol acyltransferase family protein polynucleotide (XM_002872909.1)
SEQ ID NO:134 *Arabidopsis lyrata* GPAT6 polynucleotide (XM_002881518.1)
SEQ ID NO:135 *Vernicia fordii* putative GPAT8 polynucleotide (FJ479753.1)
SEQ ID NO:136 *Oryza sativa* Os03g0735900 polynucleotide (NM_001057724.1)
SEQ ID NO:137 *Arabidopsis thaliana* GPAT4 polynucleotide (NM_100043.4)
SEQ ID NO:138 *Populus trichocarpa* predicted protein polynucleotide (XM_002320102.1)
SEQ ID NO:139 *Sorghum bicolor* protein polynucleotide (XM_002451332.1)
SEQ ID NO:140 *Ricinus communis* ER glycerol-phosphate acyltransferase polynucleotide (XM_002531304.1)
SEQ ID NO:141 *Arabidopsis lyrata* GPAT4 polynucleotide (XM_002889315.1)
SEQ ID NO:142 *Arabidopsis thaliana* GPAT1 polynucleotide (NM_100531.2)
SEQ ID NO:143 *Arabidopsis thaliana* GPAT3 polynucleotide (NM_116426.2)
SEQ ID NO:144 *Arabidopsis thaliana* GPAT4 polypeptide (NP_171667.1)
SEQ ID NO:145 *Arabidopsis thaliana* GPAT6 polypeptide (NP_181346.1)
SEQ ID NO:146 *Arabidopsis thaliana* F5110.4 gene product polypeptide (AAF02784.1)
SEQ ID NO:147 *Arabidopsis thaliana* unknown protein polypeptide (AAL32544.1)
SEQ ID NO:148 *Oryza saliva* protein polypeptide (AAP03413.1)
SEQ ID NO:149 *Picea sitchensis* unknown polypeptide (ABK25381.1)
SEQ ID NO:150 *Zea mays* unknown polypeptide (ACN34546.1)
SEQ ID NO:151 *Arabidopsis thaliana* predicted protein polypeptide (BAF00762.1)
SEQ ID NO:152 *Oryza sativa* unnamed protein product polypeptide (BAH00933.1)
SEQ ID NO:153 *Oryza sativa* predicted protein OsI_05566 polypeptide (EAY84189.1)
SEQ ID NO:154 *Oryza sativa* predicted protein OsI_20155 polypeptide (EAY98245.1)
SEQ ID NO:155 *Oryza sativa* predicted protein OsJ_05094 polypeptide (EAZ21484.1)
SEQ ID NO:156 *Oryza sativa* predicted protein OsI_04478 polypeptide (EEC71826.1)
SEQ ID NO:157 *Oryza Saliva* Predicted Protein OsI_13423 Polypeptide (EEC76137.1)
SEQ ID NO:158 *Oryza sativa* predicted protein OsJ_12482 polypeptide (EEE59882.1)
SEQ ID NO:159 Selaginella moellendorffii predicted protein SELMODRAFT_269600 polypeptide (EFJ08963.1)
SEQ ID NO:160 *Selaginella moellendorffii* predicted protein SELMODRAFT_184962 polypeptide (EFJ08964.1)
SEQ ID NO:161 *Selaginella moellendorffii* predicted protein SELMODRAFT_235331 polypeptide (EFJ11200.1)
SEQ ID NO:162 *Selaginella moellendorffii* predicted protein SELMODRAFT_118155 polypeptide (EFJ15664.1)
SEQ ID NO:163 *Selaginella moellendorffii* predicted protein SELMODRAFT_102257 polypeptide (EFJ24086.1)
SEQ ID NO:164 Selaginella moellendorffii predicted protein SELMODRAFT_170164 polypeptide (EFJ29816.1)
SEQ ID NO:165 *Selaginella moellendorffii* predicted protein SELMODRAFT_170165 polypeptide (EFJ29817.1)
SEQ ID NO:166 *Oryza sativa* Os01g0855000 polypeptide (NP_001044839.1)
SEQ ID NO:167 *Oryza sativa* Os02g0114400 polypeptide (NP_001045668.1)
SEQ ID NO:168 *Zea mays* GPAT 8 polypeptide (NP_001147442.1)
SEQ ID NO:169 *Zea mays* LOC100282930 polypeptide (NP_001149307.1)

SEQ ID NO:170 *Zea mays* protein LOC100382119 polypeptide (NP_001168351.1.)
SEQ ID NO:171 *Arabidopsis thaliana* GPAT6 polypeptide (NP_181346.1)
SEQ ID NO:172 *Arabidopsis thaliana* GPAT8 polypeptide (NP_191950.2)
SEQ ID NO:173 *Physcomitrella patens* protein polypeptide (XP_001765001.1)
SEQ ID NO:174 *Physcomitrella patens* protein polypeptide (XP_001769671.1)
SEQ ID NO:175 *Physcomitrella patens* protein polypeptide (XP_001769724.1)
SEQ ID NO:176 *Physcomitrella patens* protein polypeptide (XP_001771186.1)
SEQ ID NO:177 *Physcomitrella patens* protein polypeptide (XP_001780533.1)
SEQ ID NO:178 *Vitis vinifera* protein polypeptide (XP_002268513.1)
SEQ ID NO:179 *Vitis vinifera* protein polypeptide (XP_002275348.1)
SEQ ID NO:180 *Vitis Vinifera* protein polypeptide (XP_002276032.1)
SEQ ID NO:181 *Vitis Vinifera* protein polypeptide (XP_002279091.1)
SEQ ID NO:182 *Populus trichocarpa* protein polypeptide (XP_002309124.1)
SEQ ID NO:183 *Populus trichocarpa* protein polypeptide (XP_002309276.1)
SEQ ID NO:184 *Populus trichocarpa* protein polypeptide (XP_002322752.1)
SEQ ID NO:185 *Populus trichocarpa* protein polypeptide (XP_002323563.1)
SEQ ID NO:186 *Sorghum bicolor* protein SORBIDRAFT_09g022020 polypeptide (XP_002439887.1)
SEQ ID NO:187 *Sorghum bicolor* protein SORBIDRAFT_03g040260 polypeptide (XP_002458786.1)
SEQ ID NO:188 *Sorghum bicolor* protein SORBIDRAFT_01g008880 polypeptide (XP_002463916.1)
SEQ ID NO:189 *Sorghum bicolor* protein SORBIDRAFT_01g022140 polypeptide (XP_002464630.1)
SEQ ID NO:190 *Ricinus communis* ER glycerol-phosphate acyltransferase polypeptide (XP_002511873.1)
SEQ ID NO:191 *Ricinus communis* ER glycerol-phosphate acyltransferase polypeptide (XP_002517438.1)
SEQ ID NO:192 *Ricinus communis* ER glycerol-phosphate acyltransferase polypeptide (XP_002520171.1)
SEQ ID NO:193 *Arabidopsis lyrata* phospholipid/glycerol acyltransferase family protein polypeptide (XP_002872955.1)
SEQ ID NO:194 *Arabidopsis lyrata* GPAT6 polypeptide (XP_002881564.1)
SEQ ID NO:195 *Vernicia fordii* putative GPAT polypeptide (ACT32032.1)
SEQ ID NO:196 *Oryza sativa* Os03g0735900 polypeptide (NP_001051189.1)
SEQ ID NO:197 *Arabidopsis thaliana* GPAT4 polypeptide (NP_171667.1)
SEQ ID NO:198 *Populus trichocarpa* protein polypeptide (XP_002320138.1)
SEQ ID NO:199 *Sorghum bicolor* protein SORBIDRAFT_04g001060 polypeptide (XP_002451377.1)
SEQ ID NO:200 *Ricinus communis* ER glycerol-phosphate acyltransferase polypeptide (XP_002531350.1)
SEQ ID NO:201 *Arabidopsis lyrata* GPAT4 polypeptide (XP_002889361.1)
SEQ ID NO:202 *Arabidopsis thaliana* GPAT1 polypeptide (NP_563768.1)
SEQ ID NO:203 *Arabidopsis thaliana* GPAT3 polypeptide (NP_192104.1)
SEQ ID NO:204 *Arabidopsis thaliana* DGAT2 polynucleotide (NM_115011.3)
SEQ ID NO:205 *Ricinus communis* DGAT2 polynucleotide (AY916129.1)
SEQ ID NO:206 *Vernicia fordii* DGAT2 polynucleotide (DQ356682.1)
SEQ ID NO:207 *Mortierella ramanniana* DGAT2 polynucleotide (AF391089.1)
SEQ ID NO:208 *Homo sapiens* DGAT2 polynucleotide (NM_032564.1)
SEQ ID NO:209 *Homo sapiens* DGAT2 polynucleotide (NM_001013579.2)
SEQ ID NO:210 *Bos taurus* DGAT2 polynucleotide (NM_205793.2)
SEQ ID NO:211 *Mus musculus* DGAT2 polynucleotide (AF384160.1)
SEQ ID NO:212 *Arabidopsis thaliana* DGAT2 polypeptide (NP_566952.1)
SEQ ID NO:213 *Ricinus communis* DGAT2 polypeptide (AAY16324.1)
SEQ ID NO:214 *Vernicia fordii* DGAT2 polypeptide (ABC94474.1)
SEQ ID NO:215 *Mortierella ramanniana* DGAT2 polypeptide (AAK84179.1)
SEQ ID NO:216 *Homo sapiens* DGAT2 polypeptide (Q96PD7.2)
SEQ ID NO:217 *Homo sapiens* DGAT2 polypeptide (Q58HT5.1)
SEQ ID NO:218 *Bos taurus* DGAT2 polypeptide (Q70VZ8.1)
SEQ ID NO:219 *Mus musculus* DGAT2 polypeptide (AAK84175.1)
SEQ ID NO:220 YFP tripeptide—conserved DGAT2 and/or MGAT1/2 sequence motif
SEQ ID NO:221 HPHG tetrapeptide—conserved DGAT2 and/or MGAT1/2 sequence motif
SEQ ID NO:222 EPHS tetrapeptide—conserved plant DGAT2 sequence motif
SEQ ID NO:223 RXGFX(K/R)XAXXXGXXX(UV)VPXXXFG(E/Q)—long conserved sequence motif of DGAT2 which is part of the putative glycerol phospholipid domain
SEQ ID NO:224 FLXLXXXN—conserved sequence motif of mouse DGAT2 and MGAT1/2 which is a putative neutral lipid binding domain
SEQ ID NO:225 plsC acyltransferase domain (PF01553) of GPAT
SEQ ID NO:226 HAD-like hydrolase (PF12710) superfamily domain of GPAT
SEQ ID NO:227 Phosphoserine phosphatase domain (PF00702). GPAT4-8 contain a N-terminal region homologous to this domain
SEQ ID NO:228 Conserved GPAT amino acid sequence GDLVICPEGTTCREP
SEQ ID NO:229 Conserved GPAT/phosphatase amino acid sequence (Motif I)
SEQ ID NO:230 Conserved GPAT/phosphatase amino acid sequence (Motif III)
SEQ ID NO:231 Conserved GPAT/phosphatase amino acid sequence (Motif III)
SEQ ID NO:232 Conserved GPAT/phosphatase amino acid sequence (Motif III)

SEQ ID NO:233 Conserved GPAT/phosphatase amino acid sequence (Motif III)

DETAILED DESCRIPTION OF THE INVENTION

General Techniques and Definitions

Unless specifically defined otherwise, all technical and scientific terms used herein shall be taken to have the same meaning as commonly understood by one of ordinary skill in the art (e.g., in cell culture, molecular genetics, immunology, immunohistochemistry, protein chemistry, lipid and fatty acid chemistry, biofeul production, and biochemistry).

Unless otherwise indicated, the recombinant protein, cell culture, and immunological techniques utilized in the present invention are standard procedures, well known to those skilled in the art. Such techniques are described and explained throughout the literature in sources such as, J. Perbal, A Practical Guide to Molecular Cloning, John Wiley and Sons (1984), J. Sambrook et al., Molecular Cloning: A Laboratory Manual, Cold Spring Harbour Laboratory Press (1989), T. A. Brown (editor), Essential Molecular Biology: A Practical Approach, Volumes 1 and 2, IRL Press (1991), D. M. Glover and B. D. Hames (editors), DNA Cloning: A Practical Approach, Volumes 1-4, IRL Press (1995 and 1996), F. M. Ausubel et al. (editors), Current Protocols in Molecular Biology, Greene Pub. Associates and Wiley-Interscience (1988, including all updates until present), Ed Harlow and David Lane (editors) Antibodies: A Laboratory Manual, Cold Spring Harbour Laboratory, (1988), and J. E. Coligan et al. (editors) Current Protocols in Immunology, John Wiley & Sons (including all updates until present).

Selected Definitions

The term "transgenic non-human organism" refers to, for example, a whole plant, alga, non-human animal, or an organism suitable for fermentation such as a yeast or fungus, comprising an exogenous polynucleotide (transgene) or an exogenous polypeptide. In an embodiment, the transgenic non-human organism is not an animal or part thereof. In one embodiment, the transgenic non-human organism is a phototrophic organism (for example, a plant or alga) capable of obtaining energy from sunlight to synthesize organic compounds for nutrition. In another embodiment, the transgenic non-human organism is a photosyntheic bacterium. The term "exogenous" in the context of a polynucleotide or polypeptide refers to the polynucleotide or polypeptide when present in a cell in an altered amount compared to its native state. In one embodiment, the cell is a cell that does not naturally comprise the polynucleotide or polypeptide. In another embodiment, the exogenous polynucleotide or polypeptide is from a different genus. In another embodiment, the exogenous polynucleotide or polypeptide is from a different species. In one embodiment the exogenous polynucleotide or polypeptide is expressed in a host plant or plant cell and the exogenous polynucleotide or polypeptide is from a different species or genus. In one embodiment, the exogenous polypeptide is an exogenous MGAT. As used herein, the term "extracted lipid" refers to a composition extracted from a transgenic organism or part thereof which comprises at least 60% (w/w) lipid.

As used herein, the term "non-polar lipid" refers to fatty acids and derivatives thereof which are soluble in organic solvents but insoluble in water. The fatty acids may be free fatty acids and/or in an esterified form. Examples of esterified forms include, but are not limited to, triacylglycerol (TAG), diacylglycerol (DAG), monoacylglycerol (MAG). Non-polar lipids also include sterols, sterol esters and wax esters. Non-polar lipids are also known as "neutral lipids". Non-polar lipid is typically a liquid at room temperature. Preferably, the non-polar lipid predominantly (>50%) comprises fatty acids that are at least 16 carbons in length. More preferably, at least 50% of the total fatty acids in the non-polar lipid are C18 fatty acids for example, oleic acid. In an embodiment, at least 50%, more preferably at least 70%, more preferably at least 80%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99% of the fatty acids in non-polar lipid of the invention can be found as TAG. The non-polar lipid may be further purified or treated, for example by hydrolysis with a strong base to release the free fatty acid, or by fractionation, distillation, or the like. Non-polar lipid of the invention may form part of "seedoil" if it is obtained from seed. Non-polar lipid may be present in or obtained from other plant parts, including leaves or fruit, from recombinant cells or non-human organisms, in which case the lipid is not seedoil as defined herein.

The free and esterified sterol (for example, sitosterol, campesterol, stigmasterol, brassicasterol, D5-avenasterol, sitostanol, campestanol, and cholesterol) concentrations in the extracted lipid may be as described in Phillips et al., 2002.

As used herein, the term "seedoil" refers to a composition obtained from the seed/grain of a plant which comprises at least 60% (w/w) lipid, or obtainable from the seed/grain if the seedoil is still present in the seed/grain. That is, seedoil of the invention includes seedoil which is present in the seed/grain or portion thereof, as well as seedoil which has been extracted from the seed/grain. The seedoil is preferably extracted seedoil. Seedoil is typically a liquid at room temperature. Preferably, the total fatty acid (TFA) content in the seedoil predominantly (>50%) comprises fatty acids that are at least 16 carbons in length. More preferably, at least 50% of the total fatty acids in the seedoil are C18 fatty acids for example, oleic acid. The fatty acids are typically in an esterified form such as for example, TAG, DAG, acyl-CoA or phospholipid. The fatty acids may be free fatty acids and/or in an esterified form. In an embodiment, at least 50%, more preferably at least 70%, more preferably at least 80%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99% of the fatty acids in seedoil of the invention can be found as TAG. In an embodiment, seedoil of the invention is "substantially purified" or "purified" oil that has been separated from one or more other lipids, nucleic acids, polypeptides, or other contaminating molecules with which it is associated in the seed or in a crude extract. It is preferred that the substantially purified seedoil is at least 60% free, more preferably at least 75% free, and more preferably, at least 90% free from other components with which it is associated in the seed or extract. Seedoil of the invention may further comprise non-fatty acid molecules such as, but not limited to, sterols. In an embodiment, the seedoil is canola oil (*Brassica napus, Brassica rapa* ssp.), mustard oil (*Brassica juncea*), other *Brassica* oil (e.g., *Brassica napobrassica, Brassica camelina*), sunflower oil (*Helianthus annus*), linseed oil (*Linum usitatissimum*), soybean oil (*Glycine max*), safflower oil (*Carthamus tinctorius*), corn oil (*Zea mays*), tobacco oil (*Nicotiana tabacum*), peanut oil (*Arachis hypogaea*), palm oil (*Elaeis guineensis*), cottonseed oil (*Gossypium hirsutum*), coconut oil (*Cocos nucifera*), avocado oil (*Persea americana*), olive oil (*Olea europaea*), cashew oil (*Anacardium occidentale*), macadamia oil (*Macadamia intergrifolia*), almond oil (*Prunus amygdalus*), oat seed oil (*Avena sativa*), rice oil (*Oryza sativa* or *Oryza glaberrima*), or *Arabidopsis* seed oil (*Arabidopsis thaliana*). Seedoil may be extracted from seed/grain by any method known in the art. This typically involves extraction with nonpolar solvents such as diethyl ether, petroleum ether, chloroform/methanol or butanol mixtures, generally associated with first crushing of the seeds. Lipids associated with the starch in the grain may be extracted with water-saturated butanol. The seedoil may be "de-gummed" by methods known in the art to remove polysaccharides or treated in other ways to remove contaminants or improve purity, stability, or colour. The TAGs and other esters in the seedoil may be hydrolysed to release free fatty acids, or the seedoil hydrogenated, treated chemically, or enzymatically as known in the art.

As used herein, the term "fatty acid" refers to a carboxylic acid with a long aliphatic tail of at least 8 carbon atoms in length, either saturated or unsaturated. Typically, fatty acids have a carbon-carbon bonded chain of at least 12 carbons in length. Most naturally occurring fatty acids have an even number of carbon atoms because their biosynthesis involves acetate which has two carbon atoms. The fatty acids may be in a free state (non-esterified) or in an esterified form such as part of a TAG, DAG, MAG, acyl-CoA (thio-ester) bound, or other covalently bound form. When covalently bound in an esterified form, the fatty acid is referred to herein as an "acyl" group. The fatty acid may be esterified as a phospholipid such as a phosphatidylcholine (PC), phosphatidylethanolamine, phosphatidylserine, phosphatidylglycerol, phosphatidylinositol, or diphosphatidylglycerol. Saturated fatty acids do not contain any double bonds or other functional groups along the chain. The term "saturated" refers to hydrogen, in that all carbons (apart from the carboxylic acid [—COOH] group) contain as many hydrogens as possible. In other words, the omega (ω) end contains 3 hydrogens ($CH_3$—) and each carbon within the chain contains 2 hydrogens (—$CH_2$—). Unsaturated fatty acids are of similar form to saturated fatty acids, except that one or more alkene functional groups exist along the chain, with each alkene substituting a singly-bonded "—$CH_2$—$CH_2$—" part of the chain with a doubly-bonded "—CH=CH—" portion (that is, a carbon double bonded to another carbon). The two next carbon atoms in the chain that are bound to either side of the double bond can occur in a cis or trans configuration.

As used herein, the terms "polyunsaturated fatty acid" or "PUFA" refer to a fatty acid which comprises at least 12 carbon atoms in its carbon chain and at least two alkene groups (carbon-carbon double bonds).

"Monoacylglyceride" or "MAG" is glyceride in which the glycerol is esterified with one fatty acid. As used herein, MAG comprises a hydroxyl group at an sn-1/3 (also referred to herein as sn-1 MAG or 1-MAG or 1/3-MAG) or sn-2 position (also referred to herein as 2-MAG), and therefore MAG does not include phosphorylated molecules such as PA or PC. MAG is thus a component of neutral lipids in a cell.

"Diacylglyceride" or "DAG" is glyceride in which the glycerol is esterified with two fatty acids. As used herein, DAG comprises a hydroxyl group at a sn-1,3 or sn-1,2/2,3 position, and therefore DAG does not include phosphorylated molecules such as PA or PC. DAG is thus a component of neutral lipids in a cell. In the Kennedy pathway of DAG synthesis (FIG. 1), the precursor sn-glycerol-3-phosphate (G-3-P) is esterified to two acyl groups, each coming from a fatty acid coenzyme A ester, in a first reaction catalysed by a glycerol-3-phosphate acyltransferase (GPAT) at position sn-1 to form LysoPA, followed by a second acylation at position sn-2 catalysed by a lysophosphatidic acid acyltransferase (LPAAT) to form phosphatidic acid (PA). This intermediate is then de-phosphorylated to form DAG. In an alternative anabolic pathway (FIG. 1), DAG may be formed by the acylation of either sn-1 MAG or preferably sn-2 MAG, catalysed by MGAT. DAG may also be formed from TAG by removal of an acyl group by a lipase, or from PC essentially by removal of a choline headgroup by any of the enzymes CPT, PDCT or PLC (FIG. 1).

"Triacylglyceride" or "TAG" is glyceride in which the glycerol is esterified with three fatty acids. In the Kennedy pathway of TAG synthesis, DAG is formed as described above, and then a third acyl group is esterified to the glycerol backbone by the activity of DGAT. Alternative pathways for formation of TAG include one catalysed by the enzyme PDAT and the MGAT pathway described herein.

As used herein, the term "acyltransferase" refers to a protein which is capable of transferring an acyl group from acyl-CoA onto a substrate and includes MGATs, GPATs and DGATs.

As used herein, the term "monoacylglycerol acyltransferase" or "MGAT" refers to a protein which transfers a fatty acyl group from acyl-CoA to a MAG substrate to produce DAG. Thus, the term "monoacylglycerol acyltransferase activity" at least refers to the transfer of an acyl group from acyl-CoA to MAG to produce DAG. MGAT is best known for its role in fat absorption in the intestine of mammals, where the fatty acids and sn-2 MAG generated from the digestion of dietary fat are resynthesized into TAG in enterocytes for chylomicron synthesis and secretion. MGAT catalyzes the first step of this process, in which the acyl group from fatty acyl-CoA, formed from fatty acids and CoA, and sn-2 MAG are covalently joined. The term "MGAT" as used herein includes enzymes that act on sn-1/3 MAG and/or sn-2 MAG substrates to form sn-1,3 DAG and/or sn-1,2/2,3-DAG, respectively. In a preferred embodiment, the MGAT has a preference for sn-2 MAG substrate relative to sn-1 MAG, or substantially uses only sn-2 MAG as substrate (examples include MGATs described in Cao et al., 2003 (specificity of mouse MGAT1 for sn2-18:1-MAG>sn1/3-18:1-MAG (FIG. 5)); Yen and Farese, 2003 (general activities of mouse MGAT1 and human MGAT2 are higher on 2-MAG than on 1-MAG acyl-acceptor substrates (FIG. 5); and Cheng et al., 2003 (activity of human MGAT3 on 2-MAGs is much higher than on 1/3-MAG substrates (FIG. 2D)).

As used herein, MGAT does not include enzymes which transfer an acyl group preferentially to LysoPA relative to MAG, such enzymes are known as LPAATs. That is, a MGAT preferentially uses non-phosphorylated monoacyl substrates, even though they may have low catalytic activity on LysoPA. A preferred MGAT does not have detectable activity in acylating LysoPA. As shown herein, a MGAT (i.e., *M. musculus* MGAT2) may also have DGAT function but predominantly functions as a MGAT, i.e., it has greater catalytic activity as a MGAT than as a DGAT when the enzyme activity is expressed in units of nmoles product/min/mg protein (also see Yen et al., 2002).

There are three known classes of MGAT, referred to as, MGAT1, MGAT2 and MGAT3, respectively. Homologs of the human MGAT1 gene (AF384163) are present (i.e. sequences are known) at least in chimpanzee, dog, cow, mouse, rat, zebrafish, *Caenorhabditis elegans*, *Schizosaccharomyces pombe*, *Saccharomyces cerevisiae*, *Kluyveromyces lactis*, *Eremothecium gossypii*, *Magnaporthe grisea*, and *Neurospora crassa*. Homologs of the human MGAT2 gene (AY157608) are present at least in chimpanzee, dog, cow, mouse, rat, chicken, zebrafish, fruit fly, and mosquito. Homologs of the human MGAT3 gene (AY229854) are present at least in chimpanzee, dog, cow, and zebrafish. However, homologs from other organisms can be readily identified by methods known in the art for identifying homologous sequences.

Examples of MGAT1 polypeptides include proteins encoded by MGAT1 genes from *Homo sapiens* (AF384163), *Mus musculus* (AF384162), Pan troglodytes (XM_001166055, XM_0526044.2), *Canis familiaris* (XM_545667.2), *Bos taurus* (NM_001001153.2), *Rattus norvegicus* (NM_001108803.1), Danio rerio MGAT1 (NM_001122623.1), *Caenorhabditis elegans* (NM_073012.4, NM_182380.5, NM_065258.3, NM_075068.3, NM_072248.3), *Kluyveromyces lactis* (XM_455588.1), *Ashbya gossypii* (NM_208895.1), *Magnaporthe oryzae* (XM_368741.1), Ciona intestinalis predicted (XM_002120843.1). Examples of MGAT2 polypeptides include proteins encoded by MGAT2 genes from *Homo sapiens* (AY157608), *Mus musculus* (AY157609), Pan troglodytes (XM_522112.2), *Canis familiaris* (XM_542304.1), *Bos taurus* (NM_001099136.1), *Rattus norvegicus, Gallus gallus* (XM_424082.2), *Danio rerio* (NM_001006083.1), *Drosophila melanogaster* (NM_136474.2, NM_136473.2, NM_136475.2), *Anopheles gambiae* (XM_001688709.1, XM_315985), *Tribolium castaneum* (XM_970053.1). Examples of MGAT3 polypeptides include proteins encoded by MGAT3 genes from *Homo sapiens* (AY229854), Pan troglodytes (XM_001154107.1, XM_001154171.1, XM_527842.2), *Canis familiaris* (XM_845212.1), *Bos taurus* (XM_870406.4), *Danio rerio* (XM_688413.4).

As used herein "MGAT pathway" refers to an anabolic pathway, different to the Kennedy pathway for the formation of TAG, in which DAG is formed by the acylation of either sn-1 MAG or preferably sn-2 MAG, catalysed by MGAT. The DAG may subsequently be used to form TAG or other lipids. The MGAT pathway is exemplified in FIG. 1. As used herein, the term "diacylglycerol acyltransferase" (DGAT) refers to a protein which transfers a fatty acyl group from acyl-CoA to a DAG substrate to produce TAG. Thus, the term "diacylglycerol acyltransferase activity" refers to the transfer of an acyl group from acyl-CoA to DAG to produce TAG. A DGAT may also have MGAT function but predominantly functions as a DGAT, i.e., it has greater catalytic activity as a DGAT than as a MGAT when the enzyme activity is expressed in units of nmoles product/min/mg protein (see for example, Yen et al., 2005).

There are three known types of DGAT, referred to as DGAT1, DGAT2 and DGAT3, respectively. DGAT1 polypeptides typically have 10 transmembrane domains, DGAT2 polypeptides typically have 2 transmembrane domains, whilst DGAT3 polypeptides typically have none and are thought to be soluble in the cytoplasm, not integrated into membranes. Examples of DGAT1 polypeptides include proteins encoded by DGAT1 genes from *Aspergillus fumigatus* (Accession No. XP_755172), *Arabidopsis thaliana* (CAB44774), *Ricinus communis* (AAR11479), *Vernicia fordii* (ABC94472), *Vernonia galamensis* (ABV21945, ABV21946), *Euonymus alatus* (AAV31083), *Caenorhabditis elegans* (AAF82410), *Rattus norvegicus* (NP 445889), *Homo sapiens* (NP_036211), as well as variants and/or mutants thereof. Examples of DGAT2 polypeptides include proteins encoded by DGAT2 genes from *Arabidopsis thaliana* (NP_566952.1; SEQ ID NO:212), *Ricinus communis* (AAY16324.1; SEQ ID NO:213), *Vernicia fordii* (ABC94474.1; SEQ ID NO:214), *Mortierella ramanniana* (AAK84179.1; SEQ ID NO:215), *Homo sapiens* (Q96PD7.2; SEQ ID NO:216) (Q58HT5.1; SEQ ID NO:217), *Bos taurus* (Q70VZ8.1; SEQ ID NO:218), *Mus musculus* (AAK84175.1; SEQ ID NO:219), as well as variants and/or mutants thereof.

Examples of DGAT3 polypeptides include proteins encoded by DGAT3 genes from peanut (*Arachis hypogaea*, Saha, et al., 2006), as well as variants and/or mutants thereof. A DGAT has little or no detectable MGAT activity, for example, less than 300 pmol/min/mg protein, preferably less than 200 pmol/min/mg protein, more preferably 100 pmol/min/mg protein.

DGAT2 but not DGAT1 shares high sequence homology with the MGAT enzymes, suggesting that DGAT2 and MGAT genes likely share a common genetic origin. Although multiple isoforms are involved in catalysing the same step in TAG synthesis, they may play distinct functional roles, as suggested by differential tissue distribution and subcellular localization of the DGAT/MGAT family of enzymes. In mammals, MGAT1 is mainly expressed in stomach, kidney, adipose tissue, whilst MGAT2 and MGAT3 show highest expression in the small intestine. In mammals, DGAT1 is ubiquitously expressed in many tissues, with highest expression in small intestine, whilst DGAT2 is most abundant in liver. MGAT3 only exists in higher mammals and humans, but not in rodents from bioinformatic analysis. MGAT3 shares higher sequence homology to DGAT2 than MGAT1 and MGAT3. MGAT3 exhibits significantly higher DGAT activity than MGAT1 and MGAT2 enzymes (MGAT3>MGAT1>MGAT2) when either MAGs or DAGs were used as substrates, suggesting MGAT3 functions as a putative TAG synthase.

Both MGAT1 and MGAT2 belong to the same class of acyltransferases as DGAT2. Some of the motifs that have been shown to be important for DGAT2 catalytic activity in some DGAT2s are also conserved in MGAT acyltransferases. Of particular interest is a putative neutral lipid-binding domain with the concensus sequence FLXLXXXN (SEQ ID NO:224) where each X is independently any amino acid other than proline, and N is any nonpolar amino acid, located within the N-terminal transmembrane region followed by a putative glycerol/phospholipid acyltransferase domain. The FLXLXXXN motif is found in the mouse DGAT2 (amino acids 81-88) and MGAT1/2 but not in yeast or plant DGAT2s. It is important for activity of the mouse DGAT2. Other DGAT2 and/or MGAT1/2 sequence motifs include:

1. A highly conserved YFP tripeptide (SEQ ID NO:220) in most DGAT2 polypeptides and also in MGAT1 and MGAT2, for example, present as amino acids 139-141 in mouse DGAT2. Mutating this motif within the yeast DGAT2 with non-conservative substitutions rendered the enzyme non-functional.

2. HPHG tetrapeptide (SEQ ID NO:221), highly conserved in MGATs as well as in DGAT2 sequences from animals and fungi, for example, present as amino acids 161-164 in mouse DGAT2, and important for catalytic activity at least in yeast and mouse DGAT2. Plant DGAT2 acyltransferases have a EPHS (SEQ ID NO:222) conserved sequence instead, so conservative changes to the first and fourth amino acids can be tolerated.

3. A longer conserved motif which is part of the putative glycerol phospholipid domain. An example of this motif is RXGFX(K/R)XAXXXGXXX(IJV)VPXXXFG(E/Q) (SEQ ID NO:223), which is present as amino acids 304-327 in mouse DGAT2. This motif is less conserved in amino acid sequence than the others, as would be expected from its length, but homologs can be recognised by motif searching.

The spacing may vary between the more conserved amino acids, i.e., there may be additional X amino acids within the motif, or less X amino acids compared to the sequence above.

As used herein, the term "glycerol-3-phosphate acyltransferase" or "GPAT" refers to a protein which acylates glycerol-3-phosphate (G-3-P) to form LysoPA and/or MAG, the latter product forming if the GPAT also has phosphatase activity on LysoPA. The acyl group that is transferred is typically from acyl-CoA. Thus, the term "glycerol-3-phosphate acyltransferase activity" refers to the acylation of G-3-P to form LysoPA and/or MAG. The term "GPAT" encompasses enzymes that acylate G-3-P to form sn-1 LPA and/or sn-2 LPA, preferably sn-2 LPA. In a preferred embodiment, the GPAT has phosphatase activity. In a most preferred embodiment, the GPAT is a sn-2 GPAT having phosphatase activity which produces sn-2 MAG.

As used herein, the term "sn-1 glycerol-3-phosphate acyltransferase" (sn-1 GPAT) refers to a protein which acylates sn-glycerol-3-phosphate (G-3-P) to preferentially form 1-acyl-sn-glycerol-3-phosphate (sn-1 LPA). Thus, the term "sn-1 glycerol-3-phosphate acyltransferase activity" refers to the acylation of sn-glycerol-3-phosphate to form 1-acyl-sn-glycerol-3-phosphate (sn-1 LPA).

As used herein, the term "sn-2 glycerol-3-phosphate acyltransferase" (sn-2 GPAT) refers to a protein which acylates sn-glycerol-3-phosphate (G-3-P) to preferentially form 2-acyl-sn-glycerol-3-phosphate (sn-2 LPA). Thus, the term "sn-2 glycerol-3-phosphate acyltransferase activity" refers to the acylation of sn-glycerol-3-phosphate to form 2-acyl-sn-glycerol-3-phosphate (sn-2 LPA).

The GPAT family is large and all known members contain two conserved domains, a plsC acyltransferase domain (PF01553; SEQ ID NO:225) and a HAD-like hydrolase (PE12710; SEQ ID NO:226) superfamily domain. In addition to this, in *Arabidopsis thaliana*, GPAT4-8 all contain a N-terminal region homologous to a phosphoserine phosphatase domain (PF00702; SEQ ID NO:227). GPAT4 and GPAT6 both contain conserved residues that are known to be critical to phosphatise activity, specifically conserved amino acids (shown in bold) in Motif I
(DXDX[T/V][L/V]; SEQ ID NO:229) and Motif III (K-[G/8][D/S]XXX[D/N]; SEQ ID NOs:230-233) located at the N-terminus (Yang et al., 2010). Preferably, the GPAT has sn-2 preference and phosphatase activity to produce sn-2 MAG (also referred to herein as "2-MAG") from glycerol-3-phosphate (G-3-P((FIG. 1), for example, (GPAT4 (NP_171667.1) and GPAT6(NP_181346.1)) from *Arabidopsis*. More preferably, the GPAT uses acyl-CoA as a fatty acid substrate.

Homologues of GPAT4 (NP_171667) and GPAT6 (NP_181346) include AAF02784, AAL32544, AAP03413, ABK25381, ACN34546, BAF00762, BAH00933, EAY84189, EAY98245, EAZ21484, EEC71826, EEC76137, EEE59882, EFJ08963, EFJ08964, EFJ11200, EFJ15664, EFJ24086, EFJ29816, EFJ29817, NP_001044839, NP_001045668, NP_001147442, NP_001149307, NP_001168351, NP_181346, NP_191950, XP_001765001, XP_001769671, XP_001769724, XP_001771186, XP_001780533, XP_002268513, XP_002275348, XP_002276032, XP_002279091, XP_002309124, XP_002309276, XP_002322752, XP_002323563, XP_002439887, XP_002458786, XP_002463916, XP_002464630, XP_002511873, XP_002517438, XP_002520171, XP_002872955, XP_002881564, ACT32032, ACT32032, NP_001051189, NP_171667, XP_002320138, XP_002451377, XP_002451377, XP_002531350, XP_002872955 and XP_002889361.

Conserved motifs and/or residues can be used as a sequence-based diagnostic for the identification of bifunctional GPAT/phosphatase enzymes. Alternatively, a more stringent function-based assay could be utilised. Such an assay involves, for example, feeding labelled glycerol-3-phosphate to cells or microsomes and quantifying the levels of labelled products by thin-layer chromatography or a similar technique. GPAT activity results in the production of labelled LPA whilst GPAT/phosphatase activity results in the production of labelled MAG.

As used herein, the term "wild-type" or variations thereof refers to a cell, or non-human organism or part thereof that has not been genetically modified.

The term "corresponding" refers to a cell, or non-human organism or part thereof that has the same or similar genetic background as a cell, or non-human organism or part thereof of the invention but that has not been modified as described herein (for example, the cell, or non-human organsim or part thereof lacks an exogenous polynucleotide encoding a MGAT or an exogenous MGAT). A corresponding cell or, non-human organism or part thereof can be used as a control to compare levels of nucleic acid or protein expression, or the extent and nature of trait modification, for example non-polar lipid production and/or content, with a cell, or non-human organism or part thereof modified as described herein.

As used herein "compared with" refers to comparing levels of a non-polar lipid or total non-polar lipid content of the transgenic non-human organism or part thereof expressing the one or more exogenous polynucleotides or exogenous polypeptides with a transgenic non-human organism or part thereof lacking the one or more exogenous polynucleotides or polypeptides.

As used herein, "enhanced ability to produce non-polar lipid" is a relative term which refers to the total amount of non-polar lipid being produced by a cell, or non-human organism or part thereof of the invention being increased relative to a corresponding cell, or non-human organism or part thereof. In one embodiment, the TAG and/or polyunsaturated fatty acid content of the non-polar lipid is increased.

As used herein, the term "an isolated or recombinant polynucleotide which down regulates the production and/or activity of an endogenous enzyme" or variations thereof, refers to a polynucleotide that encodes an RNA molecule that down regulates the production and/or activity (for example, encoding an siRNA), or itself down regulates the production and/or activity (for example, is an siRNA which can be delivered directly to, for example, a cell) of an endogenous enzyme for example, DGAT, sn-1 glycerol-3-phosphate acyltransferase (GPAT), 1-acyl-glycerol-3-phosphate acyltransferase (LPAAT), acyl-CoA:lysophosphatidylcholine acyltransferase (LPCAT), phosphatidic acid phosphatase (PAP), or a combination of two or more thereof.

As used herein, the term "on a weight basis" refers to the weight of a substance (for example, TAG, DAG, fatty acid) as a percentage of the weight of the composition comprising the substance (for example, seed, leaf). For example, if a transgenic seed has 25 µg total fatty acid per 120 µg seed weight; the percentage of total fatty acid on a weight basis is 20.8%.

As used herein, the term "on a relative basis" refers to the amount of a substance in a composition comprising the substance in comparison with a corresponding composition, as a percentage.

As used herein, the term "the relative non-lipid content" refers to the expression of the non-polar lipid content of a cell, organism or part thereof, or extracted lipid therefrom, in comparison with a corresponding cell, organism or part thereof, or the lipid extracted from the corresponding cell, organism or part thereof, as a percentage. For example, if a transgenic seed has 25 j.g total fatty acid, whilst the corresponding seed had 20 μg total fatty acid; the increase in non-polar lipid content on a relative basis equals 25%.

Production of Diacylylerols and Triacylglycerols

In one embodiment, the transgenic non-human organism or part thereof of the invention produces higher levels of non-polar lipids such as DAG or TAG, preferably both, than a corresponding non-human organism or part thereof. In one example, transgenic plants of the invention produce seeds and/or leaves having an increased non-polar lipid content such as DAG or TAG, preferably both, when compared to corresponding seeds and/or leaves. The non-polar lipid content of the non-human organism or part thereof is at 0.5% greater on a weight basis when compared to a corresponding non-human organism or part thereof.

In another embodiment, the transgenic non-human organism or part thereof, preferably a plant or seed, produce DAGs and/or TAGs that are enriched for one or more particular fatty acids. A wide spectrum of fatty acids can be incorporated into DAGs and/or TAGs, including saturated and unsaturated fatty acids and short-chain and long-chain fatty acids. Some non-limiting examples of fatty acids that can be incorporated into DAGs and/or TAGs include:capric (10:0), lauric (12:0), myristic (14:0), palmitic (16:0), palmitoleic (16:1), stearic (18:0), oleic (18:1), vaccenic (18:1), linoleic (18:2), eleostearic (18:3), γ-linolenic (18:3), α-linolenic (18:3ω3), stearidonic (18:4ω3), arachidic (20:0), eicosadienoic (20:2), dihomo-γ-linoleic (20:3), eicosatrienoic (20:3), arachidonic (20:4), eicosatetraenoic (20:4), eicosapentaenoic (20:5ω3), behenic (22:0), docosapentaenoic (22:5ω), docosahexaenoic (22:6ω3), lignoceric (24:0), nervonic (24:1), cerotic (26:0), and montanic (28:0) fatty acids. In one embodiment of the present invention, the transgenic organism or parts thereof is enriched for DAGs and/or TAGs comprising polyunsaturated fatty acids.

In one embodiment of the invention, the transgenic non-human organism or part thereof, preferably a plant or seed, is transformed with a chimeric DNA which encodes a MGAT as defined herein which may or may not have DGAT activity. Expression of the MGAT preferably results in higher levels of non-polar lipids such as DAG or TAG and/or increased non-polar lipid yield in said transgenic non-human organism or part thereof. In a preferred embodiment, the transgenic non-human organism is a plant.

In a further embodiment, the transgenic non-human organism or part thereof is transformed with a chimeric DNA which encodes a GPAT or a DGAT. Preferably, the organism is transformed with both chimeric DNAs, which are preferably covalently linked on one DNA molecule such as, for example, a single T-DNA molecule.

Yang et al. (2010) describe two glycerol-3-phosphate acyltransferases (GPAT4 and GPAT6) from *Arabidopsis* with sn-2 preference and phosphatase activity that are able to produce sn-2 MAG from glycerol-3-phosphate (G-3-P) (FIG. 1). These enzymes are proposed to be part of the cutin synthesis pathway. *Arabidopsis* GPAT4 and GPAT6 have been shown to use acyl-CoA as a fatty acid substrate (Zheng et al., 2003).

Combining a bifunctional GPAT/phosphatase with a MGAT yields a novel DAG synthesis pathway using G-3-P as one substrate and two acyl groups derived from acyl-CoA as the other substrates. Similarly, combining such a bifunctional GPAT/phosphatase with a MGAT which has DGAT activity yields a novel TAG synthesis pathway using glycerol-3-phosphate as one substrate and three acyl groups derived from acyl-CoA as other substrates.

Accordingly, in one embodiment of the invention, the transgenic non-human organism or part thereof is co-transformed with a bifunctional GPAT/phosphatase and with a MGAT which does not have DGAT activity. This would result in the production of MAG by the bifunctional GPAT/phosphatase which would then be converted to DAG by the MGAT and then TAG by a native DGAT or other activity.

Novel DAG production could be confirmed and selected for by, for example, performing such a co-transformation in a yeast strain containing lethal SLC1+SLC4 knockouts such as that described by Benghezal et al. (2007; FIG. 2). FIG. 2 of Benghezal et al. (2007) shows that knocking out the two yeast LPATS (SLC1 & SLC4) is lethal. The SLC1+SLC4 double yeast mutant can only be maintained because of a complementing plasmid which provides one of the sic genes (SLC1 in their case) in trans. Negative selection by adding FOA to the medium results in the loss of this complementing plasmid (counterselection of the Ura selection marker) and renders the cells non viable.

In another embodiment of the invention, the transgenic non-human organism or part thereof, preferably a plant or seed, is co-transformed with chimeric DNAs encoding a bifunctional GPAT/phosphatase and a MGAT which has DGAT activity. This would result in the production of MAG by the bifunctional GPAT/phosphatase which would then be converted to DAG and then TAG by the MGAT.

In a further embodiment, one or more endogenous GPATs with no detectable phosphatase activity are silenced, for example one or more genes encoding GPATs that acylate glycerol-3-phosphate to form LPA in the Kennedy Pathway (for example, *Arabidopsis* GPAT1) is silenced.

Substrate preferences could be engineered into the novel DAG and TAG synthesis pathways by, for example, supplying transgenic H1246 yeast strains expressing MGAT variants with a concentration of a particular free fatty acid (for example, DHA) that prevents complementation by the wild-type MGAT gene. Only the variants able to use the supplied free fatty acid would grow. Several cycles of MGAT engineering would result in the production of a MGAT with increased preference for particular fatty acids.

The various Kennedy Pathway complementations and supplementations described above could be performed in any cell type due to the ubiquitous nature of the initial substrate glycerol-3-phosphate. In one embodiment, the use of transgenes results in increased oil yields.

Polynucleotides

The terms "polynucleotide", and "nucleic acid" are used interchangeably. They refer to a polymeric form of nucleotides of any length, either deoxyribonucleotides or ribonucleotides, or analogs thereof. A polynucleotide of the invention may be of genomic, cDNA, semisynthetic, or synthetic origin, double-stranded or single-stranded and by virtue of its origin or manipulation: (1) is not associated with all or a portion of a polynucleotide with which it is associated in nature, (2) is linked to a polynucleotide other than that to which it is linked in nature, or (3) does not occur in nature. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), ribozymes, cDNA, recombinant polynucleotides, branched polynucleotides, plasmids, vectors, isolated DNA of any sequence, isolated RNA of any sequence, chimeric DNA of any sequence, nucleic acid probes, and primers. A polynucleotide may comprise modified nucleotides such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization such as by conjugation with a labeling component.

By "isolated polynucleotide" it is meant a polynucleotide which has generally been separated from the polynucleotide sequences with which it is associated or linked in its native state. Preferably, the isolated polynucleotide is at least 60% free, more preferably at least 75% free, and more preferably at least 90% free from the polynucleotide sequences with which it is naturally associated or linked.

As used herein, the term "gene" is to be taken in its broadest context and includes the deoxyribonucleotide sequences comprising the transcribed region and, if translated, the protein coding region, of a structural gene and including sequences located adjacent to the coding region on both the 5' and 3' ends for a distance of at least about 2 kb on either end and which are involved in expression of the gene. In this regard, the gene includes control signals such as promoters, enhancers, termination and/or polyadenylation signals that are naturally associated with a given gene, or heterologous control signals, in which case, the gene is referred to as a "chimeric gene". The sequences which are located 5' of the protein coding region and which are present on the mRNA are referred to as 5' non-translated sequences. The sequences which are located 3' or downstream of the protein coding region and which are present on the mRNA are referred to as 3' non-translated sequences. The term "gene" encompasses both cDNA and genomic forms of a gene. A genomic form or clone of a gene contains the coding region which may be interrupted with non-coding sequences termed "introns", "intervening regions", or "intervening sequences." Introns are segments of a gene which are transcribed into nuclear RNA (nRNA). Introns may contain regulatory elements such as enhancers. Introns are removed or "spliced out" from the nuclear or primary transcript; introns therefore are absent in the mRNA transcript. The mRNA functions during translation to specify the sequence or order of amino acids in a nascent polypeptide. The term "gene" includes a synthetic or fusion molecule encoding all or part of the proteins of the invention described herein and a complementary nucleotide sequence to any one of the above.

As used herein, "chimeric DNA" refers to any DNA molecule that is not naturally found in nature; also referred to herein as a "DNA construct". Typically, chimeric DNA comprises regulatory and transcribed or protein coding sequences that are not naturally found together in nature. Accordingly, chimeric DNA may comprise regulatory sequences and coding sequences that are derived from different sources, or regulatory sequences and coding sequences derived from the same source, but arranged in a manner different than that found in nature. The open reading frame may or may not be linked to its natural upstream and downstream regulatory elements. The open reading frame may be incorporated into, for example, the plant genome, in a non-natural location, or in a replicon or vector where it is not naturally found such as a bacterial plasmid or a viral vector. The term "chimeric DNA" is not limited to DNA molecules which are replicable in a host, but includes DNA capable of being ligated into a replicon by, for example, specific adaptor sequences.

A "transgene" is a gene that has been introduced into the genome by a transformation procedure. The terms "genetically modified", "transgenic" and variations thereof include introducing a gene into a cell by transformation or transduction, mutating a gene in a cell and genetically altering or modulating the regulation of a gene in a cell, or the progeny of any cell modified as described above.

A "genomic region" as used herein refers to a position within the genome where a transgene, or group of transgenes (also referred to herein as a cluster), have been inserted into a cell, or predecessor thereof. Such regions only comprise nucleotides that have been incorporated by the intervention of man such as by methods described herein.

A "recombinant polynucleotide" of the invention refers to a nucleic acid molecule which has been constructed or modified by artificial recombinant methods. The recombinant polynucleotide may be present in a cell in an altered amount or expressed at an altered rate (e.g., in the case of mRNA) compared to its native state. In one embodiment, the polynucleotide is introduced into a cell that does not naturally comprise the polynucleotide. Typically an exogenous DNA is used as a template for transcription of mRNA which is then translated into a continuous sequence of amino acid residues coding for a polypeptide of the invention within the transformed cell. In another embodiment, the polynucleotide is endogenous to the cell and its expression is altered by recombinant means, for example, an exogenous control sequence is introduced upstream of an endogenous gene of interest to enable the transformed cell to express the polypeptide encoded by the gene.

A recombinant polynucleotide of the invention includes polynucleotides which have not been separated from other components of the cell-based or cell-free expression system, in which it is present, and polynucleotides produced in said cell-based or cell-free systems which are subsequently purified away from at least some other components. The polynucleotide can be a contiguous stretch of nucleotides existing in nature, or comprise two or more contiguous stretches of nucleotides from different sources (naturally occurring and/or synthetic) joined to form a single polynucleotide. Typically, such chimeric polynucleotides comprise at least an open reading frame encoding a polypeptide of the invention operably linked to a promoter suitable of driving transcription of the open reading frame in a cell of interest.

With regard to the defined polynucleotides, it will be appreciated that % identity figures higher than those provided above will encompass preferred embodiments. Thus, where applicable, in light of the minimum % identity figures, it is preferred that the polynucleotide comprises a polynucleotide sequence which is at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to the relevant nominated SEQ ID NO.

A polynucleotide of, or useful for, the present invention may selectively hybridise, under stringent conditions, to a polynucleotide defined herein. As used herein, stringent conditions are those that: (1) employ during hybridisation a denaturing agent such as formamide, for example, 50% (v/v) formamide with 0.1% (w/v) bovine serum albumin, 0.1% Ficoll, 0.1% polyvinylpyrrolidone, 50 mM sodium phosphate buffer at pH 6.5 with 750 mM NaCl, 75 mM sodium citrate at 42° 0; or (2) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 g/ml), 0.1% SDS and 10% dextran sulfate at 42° C. in 0.2×SSC and 0.1% SDS, and/or (3) employ low ionic strength and high temperature for washing, for example, 0.015 M NaCl/0.0015 M sodium citrate/0.1% SDS at 50° C.

Polynucleotides of the invention may possess, when compared to naturally occurring molecules, one or more mutations which are deletions, insertions, or substitutions of nucleotide residues. Polynucleotides which have mutations relative to a reference sequence can be either naturally occurring (that is to say, isolated from a natural source) or synthetic (for example, by performing site-directed mutagenesis or DNA shuffling on the nucleic acid as described above).

Recombinant Vectors

One embodiment of the present invention includes a recombinant vector, which comprises at least one polynucleotide defined herein and is capable of delivering the polynucleotide into a host cell. Recombinant vectors include expression vectors. Recombinant vectors contain heterologous polynucleotide sequences, that is, polynucleotide sequences that are not naturally found adjacent to a polynucleotide defined herein, that preferably, are derived from a different species. The vector can be either RNA or DNA, either prokaryotic or eukaryotic, and typically is a viral vector, derived from a virus, or a plasmid. Plasmid vectors typically include additional nucleic acid sequences that provide for easy selection, amplification, and transformation of the expression cassette in prokaryotic cells, e.g., pUC-derived vectors, pSK-derived vectors, pGEM-derived vectors, pSP-derived vectors, pBS-derived vectors, or binary vectors containing one or more T-DNA regions. Additional nucleic acid sequences include origins of replication to provide for autonomous replication of the vector, selectable marker genes, preferably encoding antibiotic or herbicide resistance, unique multiple cloning sites providing for multiple sites to insert nucleic acid sequences or genes encoded in the nucleic acid construct, and sequences that enhance transformation of prokaryotic and eukaryotic (especially plant) cells.

"Operably linked" as used herein, refers to a functional relationship between two or more nucleic acid (e.g., DNA) segments. Typically, it refers to the functional relationship of transcriptional regulatory element (promoter) to a transcribed sequence. For example, a promoter is operably linked to a coding sequence of a polynucleotide defined herein, if it stimulates or modulates the transcription of the coding sequence in an appropriate cell. Generally, promoter transcriptional regulatory elements that are operably linked to a transcribed sequence are physically contiguous to the transcribed sequence, i.e., they are cis-acting. However, some transcriptional regulatory elements such as enhancers, need not be physically contiguous or located in close proximity to the coding sequences whose transcription they enhance.

When there are multiple promoters present, each promoter may independently be the same or different.

Recombinant vectors may also contain: (a) one or more secretory signals which encode signal peptide sequences, to enable an expressed polypeptide defined herein to be secreted from the cell that produces the polypeptide, or which provide for localisation of the expressed polypeptide, for example, for retention of the polypeptide in the endoplasmic reticulum (ER) in the cell, or transfer into a plastid, and/or (b) contain fusion sequences which lead to the expression of nucleic acid molecules as fusion proteins. Examples of suitable signal segments include any signal segment capable of directing the secretion or localisation of a polypeptide defined herein. Preferred signal segments include, but are not limited to, *Nicotiana nectarin* signal peptide (U.S. Pat. No. 5,939,288), tobacco extensin signal, or the soy oleosin oil body binding protein signal. Recombinant vectors may also include intervening and/or untranslated sequences surrounding and/or within the nucleic acid sequence of a polynucleotide defined herein.

To facilitate identification of transformants, the recombinant vector desirably comprises a selectable or screenable marker gene as, or in addition to, the nucleic acid sequence of a polynucleotide defined herein. By "marker gene" is meant a gene that imparts a distinct phenotype to cells expressing the marker gene and thus, allows such transformed cells to be distinguished from cells that do not have the marker. A selectable marker gene confers a trait for which one can "select" based on resistance to a selective agent (e.g., a herbicide, antibiotic, radiation, heat, or other treatment damaging to untransformed cells). A screenable marker gene (or reporter gene) confers a trait that one can identify through observation or testing, that is, by "screening" (e.g., β-glucuronidase, luciferase, GFP or other enzyme activity not present in untransformed cells). The marker gene and the nucleotide sequence of interest do not have to be linked, since co-transformation of unlinked genes as for example, described in U.S. Pat. No. 4,399,216, is also an efficient process in for example, plant transformation. The actual choice of a marker is not crucial as long as it is functional (i.e., selective) in combination with the cells of choice such as a plant cell.

Examples of bacterial selectable markers are markers that confer antibiotic resistance such as ampicillin, erythromycin, chloramphenicol, or tetracycline resistance, preferably kanamycin resistance. Exemplary selectable markers for selection of plant transformants include, but are not limited to, a hyg gene which encodes hygromycin B resistance; a neomycin phosphotransferase (nptII) gene conferring resistance to kanamycin, paromomycin, G418; a glutathione-S-transferase gene from rat liver conferring resistance to glutathione derived herbicides as for example, described in EP 256223; a glutamine synthetase gene conferring, upon overexpression, resistance to glutamine synthetase inhibitors such as phosphinothricin as for example, described in WO 87/05327; an acetyltransferase gene from *Streptomyces viridochromogenes* conferring resistance to the selective agent phosphinothricin as for example, described in EP 275957; a gene encoding a 5-enolshikimate-3-phosphate synthase (EPSPS) conferring tolerance to N-phosphonomethylglycine as for example, described by Hinchee et al. (1988); a bar gene conferring resistance against bialaphos as for example, described in WO91/02071; a nitrilase gene such as bxn from Klebsiella ozaenae which confers resistance to bromoxynil (Stalker et al., 1988); a dihydrofolate reductase (DHFR) gene conferring resistance to methotrexate (Thillet et al., 1988); a mutant acetolactate synthase gene (ALS) which confers resistance to imidazolinone, sulfonylurea, or other ALS-inhibiting chemicals (EP 154,204); a mutated anthranilate synthase gene that confers resistance to 5-methyl tryptophan; or a dalapon dehalogenase gene that confers resistance to the herbicide.

Preferred screenable markers include, but are not limited to, a uidA gene encoding a β-glucuronidase (GUS) enzyme for which various chromogenic substrates are known; a β-galactosidase gene encoding an enzyme for which chromogenic substrates are known; an aequorin gene (Prasher et al., 1985) which may be employed in calcium-sensitive bioluminescence detection; a green fluorescent protein gene (Niedz et al., 1995) or derivatives thereof; or a luciferase (luc) gene (Ow et al., 1986) which allows for bioluminescence detection. By "reporter molecule" it is meant a molecule that, by its chemical nature, provides an analytically identifiable signal that facilitates determination of promoter activity by reference to protein product.

Preferably, the recombinant vector is stably incorporated into the genome of the cell such as the plant cell. Accordingly, the recombinant vector may comprise appropriate elements which allow the vector to be incorporated into the genome, or into a chromosome of the cell.

Expression Vector

As used herein, an "expression vector" is a DNA or RNA vector that is capable of transforming a host cell and of effecting expression of one or more specified polynucleotides. Preferably, the expression vector is also capable of replicating within the host cell. Expression vectors can be either prokaryotic or eukaryotic, and are typically viruses or plasmids. Expression vectors of the present invention include any vectors that function (i.e., direct gene expression) in host cells of the present invention, including in bacterial, fungal, endoparasite, arthropod, animal, algal, and plant cells. Particularly preferred expression vectors of the present invention can direct gene expression in yeast, algae and/or plant cells.

Expression vectors of the present invention contain regulatory sequences such as transcription control sequences, translation control sequences, origins of replication, and other regulatory sequences that are compatible with the host cell and that control the expression of polynucleotides of the present invention. In particular, expression vectors of the present invention include transcription control sequences. Transcription control sequences are sequences which control the initiation, elongation, and termination of transcription. Particularly important transcription control sequences are those which control transcription initiation such as promoter, enhancer, operator and repressor sequences. Suitable transcription control sequences include any transcription control sequence that can function in at least one of the recombinant cells of the present invention. The choice of the regulatory sequences used depends on the target organism such as a plant and/or target organ or tissue of interest. Such regulatory sequences may be obtained from any eukaryotic organism such as plants or plant viruses, or may be chemically synthesized. A variety of such transcription control sequences are known to those skilled in the art. Particularly preferred transcription control sequences are promoters active in directing transcription in plants, either constitutively or stage and/or tissue specific, depending on the use of the plant or part(s) thereof.

A number of vectors suitable for stable transfection of plant cells or for the establishment of transgenic plants have been described in for example, Pouwels et al., Cloning Vectors: A Laboratory Manual, 1985, supp. 1987, Weissbach and Weissbach, Methods for Plant Molecular Biology, Academic Press, 1989, and Gelvin et al., Plant Molecular Biology Manual, Kluwer Academic Publishers, 1990. Typically, plant expression vectors include for example, one or more cloned plant genes under the transcriptional control of 5' and 3' regulatory sequences and a dominant selectable marker. Such plant expression vectors also can contain a promoter regulatory region (e.g., a regulatory region controlling inducible or constitutive, environmentally- or developmentally-regulated, or cell- or tissue-specific expression), a transcription initiation start site, a ribosome binding site, an RNA processing signal, a transcription termination site, and/or a polyadenylation signal.

A number of constitutive promoters that are active in plant cells have been described. Suitable promoters for constitutive expression in plants include, but are not limited to, the cauliflower mosaic virus (CaMV) 35S promoter, the Figwort mosaic virus (FMV) 35S, the sugarcane bacilliform virus promoter, the commelina yellow mottle virus promoter, the light-inducible promoter from the small subunit of the ribulose-1,5-bis-phosphate carboxylase, the rice cytosolic triose-phosphate isomerase promoter, the adenine phosphoribosyl-transferase promoter of *Arabidopsis*, the rice actin 1 gene promoter, the mannopine synthase and octopine synthase promoters, the Adh promoter, the sucrose synthase promoter, the R gene complex promoter, and the chlorophyll c/R binding protein gene promoter. These promoters have been used to create DNA vectors that have been expressed in plants, see for example, WO 84/02913. All of these promoters have been used to create various types of plant-expressible recombinant DNA vectors.

For the purpose of expression in source tissues of the plant such as the leaf, seed, root or stem, it is preferred that the promoters utilized in the present invention have relatively high expression in these specific tissues. For this purpose, one may choose from a number of promoters for genes with tissue- or cell-specific, or -enhanced expression. Examples of such promoters reported in the literature include, the chloroplast glutamine synthetase GS2 promoter from pea, the chloroplast fructose-1,6-biphosphatase promoter from wheat, the nuclear photosynthetic ST-LS1 promoter from potato, the serine/threonine kinase promoter and the glucoamylase (CHS) promoter from *Arabidopsis thaliana*. Also reported to be active in photosynthetically active tissues are the ribulose-1,5-bisphosphate carboxylase promoter from eastern larch (*Larix laricina*), the promoter for the Cab gene, Cab6, from pine, the promoter for the Cab-1 gene from wheat, the promoter for the Cab-1 gene from spinach, the promoter for the Cab 1R gene from rice, the pyruvate, orthophosphate dikinase (PPDK) promoter from *Zea mays*, the promoter for the tobacco Lhcb1*2 gene, the *Arabidopsis thaliana* Suc2 sucrose-$H^{30}$ symporter promoter, and the promoter for the thylakoid membrane protein genes from spinach (PsaD, PsaF, PsaE, PC, FNR, AtpC, AtpD, Cab, RbcS). Other promoters for the chlorophyll W-binding proteins may also be utilized in the present invention such as the promoters for LhcB gene and PsbP gene from white mustard (*Sinapis alba*).

A variety of plant gene promoters that are regulated in response to environmental, hormonal, chemical, and/or developmental signals, also can be used for expression of RNA-binding protein genes in plant cells, including promoters regulated by (1) heat, (2) light (e.g., pea RbcS-3A promoter, maize RbcS promoter), (3) hormones such as abscisic acid, (4) wounding (e.g., WunI), or (5) chemicals such as methyl jasmonate, salicylic acid, steroid hormones, alcohol, Safeners (WO 97/06269), or it may also be advantageous to employ (6) organ-specific promoters.

As used herein, the term "plant storage organ specific promoter" refers to a promoter that preferentially, when compared to other plant tissues, directs gene transcription in a storage organ of a plant. Preferably, the promoter only directs expression of a gene of interest in the storage organ, and/or expression of the gene of interest in other parts of the plant such as leaves is not detectable by Northern blot analysis and/or RT-PCR. Typically, the promoter drives expression of genes during growth and development of the storage organ, in particular during the phase of synthesis and accumulation of storage compounds in the storage organ. Such promoters may drive gene expression in the entire plant storage organ or only part thereof such as the seedcoat, embryo or cotyledon(s) in seeds of dicotyledonous plants or the endosperm or aleurone layer of seeds of monocotyledonous plants.

For the purpose of expression in sink tissues of the plant such as the tuber of the potato plant, the fruit of tomato, or the seed of soybean, canola, cotton, Zea mays, wheat, rice, and barley, it is preferred that the promoters utilized in the present invention have relatively high expression in these specific tissues. A number of promoters for genes with tuber-specific or -enhanced expression are known, including the class I patatin promoter, the promoter for the potato tuber ADPGPP genes, both the large and small subunits, the sucrose synthase promoter, the promoter for the major tuber proteins, including the 22 kD protein complexes and proteinase inhibitors, the promoter for the granule bound starch synthase gene (GBSS), and other class I and II patatins promoters. Other promoters can also be used to express a protein in specific tissues such as seeds or fruits. The promoter for p-conglycinin or other seed-specific promoters such as the napin, zein, linin and phaseolin promoters, can be used. Root specific promoters may also be used. An example of such a promoter is the promoter for the acid chitinase gene. Expression in root tissue could also be accomplished by utilizing the root specific subdomains of the CaMV 35S promoter that have been identified.

In a particularly preferred embodiment, the promoter directs expression in tissues and organs in which lipid biosynthesis take place. Such promoters act in seed development at a suitable time for modifying lipid composition in seeds.

In a further particularly preferred embodiment, the promoter is a plant storage organ specific promoter. In one embodiment, the plant storage organ specific promoter is a seed specific promoter. In a more preferred embodiment, the promoter preferentially directs expression in the cotyledons of a dicotyledonous plant or in the endosperm of a monocotyledonous plant, relative to expression in the embryo of the seed or relative to other organs in the plant such as leaves. Preferred promoters for seed-specific expression include: 1) promoters from genes encoding enzymes involved in lipid biosynthesis and accumulation in seeds such as desaturases and elongases, 2) promoters from genes encoding seed storage proteins, and 3) promoters from genes encoding enzymes involved in carbohydrate biosynthesis and accumulation in seeds. Seed specific promoters which are suitable are, the oilseed rape napin gene promoter (U.S. Pat. No. 5,608,152), the Viciafaba USP promoter (Baumlein et al., 1991), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), or the legumin B4 promoter (Baumlein et al., 1992), and promoters which lead to the seed-specific expression in monocots such as maize, barley, wheat, rye, rice and the like. Notable promoters which are suitable are the barley lpt2 or lpt1 gene promoter (WO 95/15389 and WO 95/23230), or the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene, the rye secalin gene). Other promoters include those described by Broun et al. (1998), Potenza et al. (2004), US 20070192902 and US 20030159173. In an embodiment, the seed specific promoter is preferentially expressed in defined parts of the seed such as the cotyledon(s) or the endosperm. Examples of cotyledon specific promoters include, but are not limited to, the FP1 promoter (Ellerstrom et al., 1996), the pea legumin promoter (Perrin et al., 2000), and the bean phytohemagglutnin promoter (Perrin et al., 2000). Examples of endosperm specific promoters include, but are not limited to, the maize zein-1 promoter (Chikwamba et al., 2003), the rice glutelin-1 promoter (Yang et al., 2003), the barley D-hordein promoter (Horvath et al., 2000) and wheat HMW glutenin promoters (Alvarez et al., 2000). In a further embodiment, the seed specific promoter is not expressed, or is only expressed at a low level, in the embryo and/or after the seed germinates.

In another embodiment, the plant storage organ specific promoter is a tuber specific promoter. Examples include, but are not limited to, the potato patatin B33, PAT21 and GBSS promoters, as well as the sweet potato sporamin promoter (for review, see Potenza et al., 2004). In a preferred embodiment, the promoter directs expression preferentially in the pith of the tuber, relative to the outer layers (skin, bark) or the embryo of the tuber.

In another embodiment, the plant storage organ specific promoter is a fruit specific promoter. Examples include, but are not limited to, the tomato polygalacturonase, E8 and Pds promoters, as well as the apple ACC oxidase promoter (for review, see Potenza et al., 2004). In a preferred embodiment, the promoter preferentially directs expression in the edible parts of the fruit, for example the pith of the fruit, relative to the skin of the fruit or the seeds within the fruit.

The 5' non-translated leader sequence can be derived from the promoter selected to express the heterologous gene sequence of the polynucleotide of the present invention, or may be heterologous with respect to the coding region of the enzyme to be produced, and can be specifically modified if desired so as to increase translation of mRNA. For a review of optimizing expression of transgenes, see Koziel et al. (1996). The 5' non-translated regions can also be obtained from plant viral RNAs (Tobacco mosaic virus, Tobacco etch virus, Maize dwarf mosaic virus, Alfalfa mosaic virus, among others) from suitable eukaryotic genes, plant genes (wheat and maize chlorophyll a/b binding protein gene leader), or from a synthetic gene sequence. The present invention is not limited to constructs wherein the non-translated region is derived from the 5' non-translated sequence that accompanies the promoter sequence. The leader sequence could also be derived from an unrelated promoter or coding sequence. Leader sequences useful in context of the present invention comprise the maize Hsp70 leader (U.S. Pat. No. 5,362,865 and U.S. Pat. No. 5,859,347), and the TMV omega element.

The termination of transcription is accomplished by a 3' non-translated DNA sequence operably linked in the expression vector to the polynucleotide of interest. The 3' non-translated region of a recombinant DNA molecule contains a polyadenylation signal that functions in plants to cause the addition of adenylate nucleotides to the 3' end of the RNA. The 3' non-translated region can be obtained from various genes that are expressed in plant cells. The nopaline synthase 3' untranslated region, the 3' untranslated region from pea small subunit Rubisco gene, the 3' untranslated region from soybean 7S seed storage protein gene are commonly used in this capacity. The 3' transcribed, non-translated regions containing the polyadenylate signal of *Agrobacterium* tumor-inducing (Ti) plasmid genes are also suitable.

Recombinant DNA technologies can be used to improve expression of a transformed polynucleotide by manipulating for example, the number of copies of the polynucleotide within a host cell, the efficiency with which those polynucleotide are transcribed, the efficiency with which the resultant transcripts are translated, and the efficiency of post-translational modifications. Recombinant techniques useful for increasing the expression of polynucleotides defined herein include, but are not limited to, operatively linking the polynucleotide to a high-copy number plasmid, integration of the polynucleotide molecule into one or more host cell chromosomes, addition of vector stability sequences to the plasmid, substitutions or modifications of transcription control signals (e.g., promoters, operators, enhancers), substitutions or modifications of translational control signals (e.g., ribosome binding sites, Shine-Dalgarno sequences), modification of the polynucleotide to correspond to the codon usage of the host cell, and the deletion of sequences that destabilize transcripts.

Transfer Nucleic Acids

Transfer nucleic acids can be used to deliver an exogenous polynucleotide to a cell and comprise one, preferably two, border sequences and a polynucleotide of interest. The transfer nucleic acid may or may not encode a selectable marker. Preferably, the transfer nucleic acid forms part of a binary vector in a bacterium, where the binary vector further comprises elements which allow replication of the vector in the bacterium, selection, or maintenance of bacterial cells containing the binary vector. Upon transfer to a eukaryotic cell, the transfer nucleic acid component of the binary vector is capable of integration into the genome of the eukaryotic cell.

As used herein, the term "extrachromosomal transfer nucleic acid" refers to a nucleic acid molecule that is capable of being transferred from a bacterium such as *Agrobacterium* sp., to a eukaryotic cell such as a plant leaf cell. An extrachromosomal transfer nucleic acid is a genetic element that is well-known as an element capable of being transferred, with the subsequent integration of a nucleotide sequence contained within its borders into the genome of the recipient cell. In this respect, a transfer nucleic acid is flanked, typically, by two "border" sequences, although in some instances a single border at one end can be used and the second end of the transferred nucleic acid is generated randomly in the transfer process. A polynucleotide of interest is typically positioned between the left border-like sequence and the right border-like sequence of a transfer nucleic acid. The polynucleotide contained within the transfer nucleic acid may be operably linked to a variety of different promoter and terminator regulatory elements that facilitate its expression, that is, transcription and/or translation of the polynucleotide. Transfer DNAs (T-DNAs) from *Agrobacterium* sp. such as *Agrobacterium tumefaciens* or *Agrobacterium rhizogenes*, and man made variants/mutants thereof are probably the best characterized examples of transfer nucleic acids. Another example is P-DNA ("plant-DNA") which comprises T-DNA border-like sequences from plants.

As used herein, "T-DNA" refers to for example, T-DNA of an *Agrobacterium tumefaciens* Ti plasmid or from an *Agrobacterium rhizogenes* Ri plasmid, or man made variants thereof which function as T-DNA. The T-DNA may comprise an entire T-DNA including both right and left border sequences, but need only comprise the minimal sequences required in cis for transfer, that is, the right and T-DNA border sequence. The T-DNAs of the invention have inserted into them, anywhere between the right and left border sequences (if present), the polynucleotide of interest flanked by target sites for a site-specific recombinase. The sequences encoding factors required in trans for transfer of the T-DNA into a plant cell such as vir genes, may be inserted into the T-DNA, or may be present on the same replicon as the T-DNA, or preferably are in trans on a compatible replicon in the *Agrobacterium* host. Such "binary vector systems" are well known in the art.

As used herein, "P-DNA" refers to a transfer nucleic acid isolated from a plant genome, or man made variants/mutants thereof, and comprises at each end, or at only one end, a T-DNA border-like sequence. The border-like sequence preferably shares at least 50%, at least 60%, at least 70%, at least 75%, at least 80%, at least 90% or at least 95%, but less than 100% sequence identity, with a T-DNA border sequence from an *Agrobacterium* sp. such as *Agrobacterium tumefaciens* or *Agrobacterium rhizogenes*. Thus, P-DNAs can be used instead of T-DNAs to transfer a nucleotide sequence contained within the P-DNA from, for example *Agrobacterium*, to another cell. The P-DNA, before insertion of the exogenous polynucleotide which is to be transferred, may be modified to facilitate cloning and should preferably not encode any proteins. The P-DNA is characterized in that it contains, at least a right border sequence and preferably also a left border sequence.

As used herein, a "border" sequence of a transfer nucleic acid can be isolated from a selected organism such as a plant or bacterium, or be a man made variant/mutant thereof. The border sequence promotes and facilitates the transfer of the polynucleotide to which it is linked and may facilitate its integration in the recipient cell genome. In an embodiment, a border-sequence is between 5-100 base pairs (bp) in length, 10-80 bp in length, 15-75 bp in length, 15-60 bp in length, 15-50 bp in length, 15-40 bp in length, 15-30 bp in length, 16-30 bp in length, 20-30 bp in length, 21-30 bp in length, 22-30 bp in length, 23-30 bp in length, 24-30 bp in length, 25-30 bp in length, or 26-30 bp in length. Border sequences from T-DNA from *Agrobacterium* sp. are well known in the art and include those described in Lacroix et al. (2008), Tzfira and Citovsky (2006) and Glevin (2003).

Whilst traditionally only *Agrobacterium* sp. have been used to transfer genes to plants cells, there are now a large number of systems which have been identified/developed which act in a similar manner to *Agrobacterium* sp. Several non-*Agrobacterium* species have recently been genetically modified to be competent for gene transfer (Chung et al., 2006; Broothaerts et al., 2005). These include *Rhizobium* sp. NGR234, *Sinorhizobium meliloti* and *Mezorhizobium loti*. The bacteria are made competent for gene transfer by providing the bacteria with the machinery needed for the transformation process, that is, a set of virulence genes encoded by an *Agrobacterium* Ti-plasmid and the T-DNA segment residing on a separate, small binary plasmid. Bacteria engineered in this way are capable of transforming different plant tissues (leaf disks, calli and oval tissue), monocots or dicots, and various different plant species (e.g., tobacco, rice).

Direct transfer of eukaryotic expression plasmids from bacteria to eukaryotic hosts was first achieved several decades ago by the fusion of mammalian cells and protoplasts of plasmid-carrying *Escherichia coli* (Schaffner, 1980). Since then, the number of bacteria capable of delivering genes into mammalian cells has steadily increased (Weiss, 2003), being discovered by four groups independently (Sizemore et al. 1995; Courvalin et al., 1995; Powell et al., 1996; Darji et al., 1997).

Attenuated *Shigella flexneri*, *Salmonella typhimurium* or *E. coli* that had been rendered invasive by the virulence plasmid (pWR100) of *S. flexneri* have been shown to be able to transfer expression plasmids after invasion of host cells and intracellular death due to metabolic attenuation. Mucosal application, either nasally or orally, of such recombinant *Shigella* or *Salmonella* induced immune responses against the antigen that was encoded by the expression plasmids. In the meantime, the list of bacteria that was shown to be able to transfer expression plasmids to mammalian host cells in vitro and in vivo has been more then doubled and has been documented for *S. typhi*, *S. choleraesuis*, *Listeria monocytogenes*, *Yersinia pseudotuberculosis*, and *Y. enterocolitica* (Fennelly et al., 1999; Shiau et al., 2001; Dietrich et al., 1998; Hense et al., 2001; Al-Mariri et al., 2002).

In general, it could be assumed that all bacteria that are able to enter the cytosol of the host cell (like *S. flexneri* or *L. monocytogenes*) and lyse within this cellular compartment, should be able to transfer DNA. This is known as 'abortive' or 'suicidal' invasion as the bacteria have to lyse for the DNA transfer to occur (Grillot-Courvalin et al., 1999). In addition, even many of the bacteria that remain in the phagocytic vacuole (like *S. typhimurium*) may also be able to do so. Thus, recombinant laboratory strains of *E. coli* that have been engineered to be invasive but are unable of phagosomal escape, could deliver their plasmid load to the nucleus of the infected mammalian cell nevertheless (Grillot-Courvalin et al., 1998). Furthermore, *Agrobacterium tumefaciens* has recently also been shown to introduce transgenes into mammalian cells (Kunik et al., 2001).

As used herein, the terms "transfection", "transformation" and variations thereof are generally used interchangeably. "Transfected" or "transformed" cells may have been manipulated to introduce the polynucleotide(s) of interest, or may be progeny cells derived therefrom.

Recombinant Cells

The invention also provides a recombinant cell, for example, a recombinant plant cell, which is a host cell transformed with one or more polynucleotides or vectors defined herein, or combination thereof. The term "recombinant cell" is used interchangeably with the term "transgenic cell" herein. Suitable cells of the invention include any cell that can be transformed with a polynucleotide or recombinant vector of the invention, encoding for example, a polypeptide or enzyme described herein. The cell is preferably a cell which is thereby capable of being used for producing lipid. The recombinant cell may be a cell in culture, a cell in vitro, or in an organism such as for example, a plant, or in an organ such as, for example, a seed or a leaf. Preferably, the cell is in a plant, more preferably in the seed of a plant.

Host cells into which the polynucleotide(s) are introduced can be either untransformed cells or cells that are already transformed with at least one nucleic acid. Such nucleic acids may be related to lipid synthesis, or unrelated. Host cells of the present invention either can be endogenously (i.e., naturally) capable of producing polypeptide(s) defined herein, in which case the recombinant cell derived therefrom has an enhanced capability of producing the polypeptide(s), or can be capable of producing said polypeptide(s) only after being transformed with at least one polynucleotide of the invention. In an embodiment, a recombinant cell of the invention has an enhanced capacity to produce non-polar lipid.

Host cells of the present invention can be any cell capable of producing at least one protein described herein, and include bacterial, fungal (including yeast), parasite, arthropod, animal, algal, and plant cells. The cells may be prokaryotic or eukaryotic. Preferred host cells are yeast, algal and plant cells. In a preferred embodiment, the plant cell is a seed cell, in particular, a cell in a cotyledon or endosperm of a seed. In one embodiment, the cell is an animal cell. The animal cell may be of any type of animal such as, for example, a non-human animal cell, a non-human vertebrate cell, a non-human mammalian cell, or cells of aquatic animals such as fish or crustacea, invertebrates, insects, etc. Non limiting examples of arthropod cells include insect cells such as *Spodoptera frugiperda* (Sf) cells, for example, Sf9, Sf21, *Trichoplusia ni* cells, and *Drosophila* S2 cells. An example of a bacterial cell useful as a host cell of the present invention is *Synechococcus* spp. (also known as *Synechocystis* spp.), for example *Synechococcus elongatus*. Examples of algal cells useful as host cells of the present invention include, for example, *Chlamydomonas* sp. (for example, *Chlamydomonas reinhardtii*), *Dunaliella* sp., *Haematococcus* sp. *Chlorella* sp., *Thraustochytrium* sp., *Schizochytrium* sp., and *Volvox* sp.

Host cells for expression of the instant nucleic acids may include microbial hosts that grow on a variety of feedstocks, including simple or complex carbohydrates, organic acids and alcohols and/or hydrocarbons over a wide range of temperature and pH values. Preferred microbial hosts are oleaginous organisms that are naturally capable of non-polar lipid synthesis.

The host cells may be of an organism suitable for a fermentation process, such as, for example, *Yarrowia lipolytica* or other yeasts.

Transgenic Plants

The invention also provides a plant comprising an exogenous polynucleotide or polypeptide of the invention, a cell of the invention, a vector of the invention, or a combination thereof. The term "plant" refers to whole plants, whilst the term "part thereof" refers to plant organs (e.g., leaves, stems, roots, flowers, fruit), single cells (e.g., pollen), seed, seed parts such as an embryo, endosperm, scutellum or seed coat, plant tissue such as vascular tissue, plant cells and progeny of the same. As used herein, plant parts comprise plant cells.

As used herein, the term "plant" is used in it broadest sense. It includes, but is not limited to, any species of grass, ornamental or decorative plant, crop or cereal (e.g., oilseed, maize, soybean), fodder or forage, fruit or vegetable plant, herb plant, woody plant, flower plant, or tree. It is not meant to limit a plant to any particular structure. It also refers to a unicellular plant (e.g., microalga). The term "part thereof" in reference to a plant refers to a plant cell and progeny of same, a plurality of plant cells that are largely differentiated into a colony (e.g., volvox), a structure that is present at any stage of a plant's development, or a plant tissue. Such structures include, but are not limited to, leaves, stems, flowers, fruits, nuts, roots, seed, seed coat, embryos. The term "plant tissue" includes differentiated and undifferentiated tissues of plants including those present in leaves, stems, flowers, fruits, nuts, roots, seed, for example, embryonic tissue, endosperm, dermal tissue (e.g., epidermis, periderm), vascular tissue (e.g., xylem, phloem), or ground tissue (comprising parenchyma, collenchyma, and/or sclerenchyma cells), as well as cells in culture (e.g., single cells, protoplasts, callus, embryos, etc.). Plant tissue may be in planta, in organ culture, tissue culture, or cell culture.

A "transgenic plant", "genetically modified plant" or variations thereof refers to a plant that contains a transgene not found in a wild-type plant of the same species, variety or cultivar. Transgenic plants as defined in the context of the present invention include plants and their progeny which have been genetically modified using recombinant techniques to cause production of at least one polypeptide defined herein in the desired plant or part thereof. Transgenic plant parts has a corresponding meaning.

The terms "seed" and "grain" are used interchangeably herein. "Grain" refers to mature grain such as harvested grain or grain which is still on a plant but ready for harvesting, but can also refer to grain after imbibition or germination, according to the context. Mature grain commonly has a moisture content of less than about 18-20%. "Developing seed" as used herein refers to a seed prior to maturity, typically found in the reproductive structures of the plant after fertilisation or anthesis, but can also refer to such seeds prior to maturity which are isolated from a plant.

As used herein, the term "plant storage organ" refers to a part of a plant specialized to store energy in the form of for example, proteins, carbohydrates, lipid. Examples of plant storage organs are seed, fruit, tuberous roots, and tubers. A preferred plant storage organ of the invention is seed.

As used herein, the term "phenotypically normal" refers to a genetically modified plant or part thereof, particularly a storage organ such as a seed, tuber or fruit of the invention not having a significantly reduced ability to grow and reproduce when compared to an unmodified plant or plant thereof. In an embodiment, the genetically modified plant or part thereof which is phenotypically normal comprises a recombinant polynucleotide encoding a silencing suppressor operably linked to a plant storage organ specific promoter and has an ability to grow or reproduce which is essentially the same as a corresponding plant or part thereof not comprising said polynucleotide. Preferably, the biomass, growth rate, germination rate, storage organ size, seed size and/or the number of viable seeds produced is not less than 90% of that of a plant lacking said recombinant polynucleotide when grown under identical conditions. This term does not encompass features of the plant which may be different to the wild-type plant but which do not effect the usefulness of the plant for commercial purposes such as, for example, a ballerina phenotype of seedling leaves.

Plants provided by or contemplated for use in the practice of the present invention include both monocotyledons and dicotyledons. In preferred embodiments, the plants of the present invention are crop plants (for example, cereals and pulses, maize, wheat, potatoes, tapioca, rice, sorghum, millet, cassava, barley, or pea), or other legumes. The plants may be grown for production of edible roots, tubers, leaves, stems, flowers or fruit. The plants may be vegetable or ornamental plants.

The plants of the invention may be: corn (*Zea mays*), canola (*Brassica napus, Brassica rapa* ssp.), other *Brassicas* such as, for example, rutabaga (*Brassica napobrassica*) or *Brassica camelina*, sugarbeet (*Beta vulgaris*) clover (*Trifolium* sp.), flax (*Linum usitatissimum*), alfalfa (*Medicago sativa*), rice (*Oryza sativa*), rye (*Secale cerale*), sorghum (*Sorghum bicolor, Sorghum vulgare*), sunflower (*Helianthus annus*), wheat (*Tritium aestivum*), soybean (*Glycine max*), tobacco (*Nicotiana tabacum*), potato (*Solanum tuberosum*), peanuts (*Arachis hypogaea*), cotton (*Gossypium hirsutum*), sweet potato (*Lopmoea batatus*), cassava (*Manihot esculenta*), coffee (*Cofea* spp.), coconut (*Cocos nucifera*), pineapple (*Anana comosus*), citris tree (*Citrus* spp.), cocoa (*Theobroma cacao*), tea (*Camellia senensis*), banana (*Musa* spp.), avocado (*Persea americana*), fig (*Ficus casica*), guava (*Psidium guajava*), mango (*Mangifer indica*), olive (*Olea europaea*), papaya (*Carica papaya*), cashew (*Anacardium occidentale*), macadamia (*Macadamia intergrifolia*), almond (*Prunus amygdalus*), sugar beets (*Beta vulgaris*), oats, or barley.

Other preferred plants include C4 grasses such as *Andropogon gerardi, Bouteloua curtipendula, B. gracilis, Buchloe dactyloides, Panicum virgatum, Schizachyrium scoparium, Miscanthus* species for example, *Miscanthus x giganteus* and *Miscanthus sinensis, Sorghastrum nutans, Sporobolus cryptandrus,* Switchgrass (*Panicum virgatum*); C3 grasses such as *Elymus canadensis,* the legumes *Lespedeza capitata* and *Petalostemum villosum,* the forb *Aster azureus;* and woody plants such as *Quercus ellipsoidalis* and *Q. macrocarpa.*

In a preferred embodiment, the plant is an angiosperm.

In an embodiment, the plant is an oilseed plant, preferably an oilseed crop plant. As used herein, an "oilseed plant" is a plant species used for the commercial production of lipid from the seeds of the plant. The oilseed plant may be oil-seed rape (such as canola), maize, sunflower, safflower, soybean, sorghum, flax (linseed) or sugar beet. Furthermore, the oilseed plant may be other *Brassicas*, cotton, peanut, poppy, rutabaga, mustard, castor bean, sesame, safflower, or nut producing plants. The plant may produce high levels of lipid in its fruit such as olive, oil palm or coconut. Horticultural plants to which the present invention may be applied are lettuce, endive, or vegetable *Brassicas* including cabbage, broccoli, or cauliflower. The present invention may be applied in tobacco, cucurbits, carrot, strawberry, tomato, or pepper.

In a preferred embodiment, the transgenic plant is homozygous for each and every gene that has been introduced (transgene) so that its progeny do not segregate for the desired phenotype. The transgenic plant may also be heterozygous for the introduced transgene(s), preferably uniformly heterozygous for the transgene such as for example, in F1 progeny which have been grown from hybrid seed. Such plants may provide advantages such as hybrid vigour, well known in the art.

Where relevant, the transgenic plants may also comprise additional transgenes encoding enzymes involved in the production of non-polar lipid such as, but not limited to LPAAT, LPCAT, PAP, or a phospholipid:diacylglycerol acyltransferase (PDAT1, PDAT2 or PDAT3; see for example, Ghosal et al., 2007), or a combination of two or more thereof. The transgenic plants of the invention may also express oleosin from an exogenous polynucleotide.

Transformation of Plants

Transgenic plants can be produced using techniques known in the art, such as those generally described in Slater et al., Plant Biotechnology—The Genetic Manipulation of Plants, Oxford University Press (2003), and Christou and Klee, Handbook of Plant Biotechnology, John Wiley and Sons (2004).

As used herein, the terms "stably transforming", "stably transformed" and variations thereof refer to the integration of the polynucleotide into the genome of the cell such that they are transferred to progeny cells during cell division without the need for positively selecting for their presence. Stable transformants, or progeny thereof, can be selected by any means known in the art such as Southern blots on chromosomal DNA, or in situ hybridization of genomic DNA.

*Agrobacterium*-mediated transfer is a widely applicable system for introducing genes into plant cells because DNA can be introduced into cells in whole plant tissues, plant organs, or explants in tissue culture, for either transient expression, or for stable integration of the DNA in the plant cell genome. The use of *Agrobacterium*-mediated plant integrating vectors to introduce DNA into plant cells is well known in the art (see for example, U.S. Pat. No. 5,177,010, U.S. Pat. No. 5,104,310, U.S. Pat. No. 5,004,863, or U.S. Pat. No. 5,159,135). The region of DNA to be transferred is defined by the border sequences, and the intervening DNA (T-DNA) is usually inserted into the plant genome. Further, the integration of the T-DNA is a relatively precise process resulting in few rearrangements. In those plant varieties where *Agrobacterium*-mediated transformation is efficient, it is the method of choice because of the facile and defined nature of the gene transfer. Preferred *Agrobacterium* transformation vectors are capable of replication in *E. coli* as well as *Agrobacterium*, allowing for convenient manipulations as described (Klee et al., In: Plant DNA Infectious Agents, Hohn and Schell, eds., Springer-Verlag, New York, pp. 179-203 (1985)).

Acceleration methods that may be used include for example, microprojectile bombardment and the like. One example of a method for delivering transforming nucleic acid molecules to plant cells is microprojectile bombardment. This method has been reviewed by Yang et al., Particle Bombardment Technology for Gene Transfer, Oxford Press, Oxford, England (1994). Non-biological particles (microprojectiles) that may be coated with nucleic acids and delivered into cells by a propelling force. Exemplary particles include those comprised of tungsten, gold, platinum, and the like. A particular advantage of microprojectile bombardment, in addition to it being an effective means of reproducibly transforming monocots, is that neither the isolation of protoplasts, nor the susceptibility of *Agrobacterium* infection are required. An illustrative embodiment of a method for delivering DNA into *Zea mays* cells by acceleration is a biolistics α-particle delivery system, that can be used to propel particles coated with DNA through a screen such as a stainless steel or Nytex screen, onto a filter surface covered with corn cells cultured in suspension. A particle delivery system suitable for use with the present invention is the helium acceleration PDS-1000/He gun available from Bio-Rad Laboratories.

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. If desired, one or more screens are also positioned between the acceleration device and the cells to be bombarded. Through the use of techniques set forth herein, one may obtain up to 1000 or more foci of cells transiently expressing a marker gene. The number of cells in a focus that express the gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include particle gun delivery of DNA containing a selectable marker and targeting of the DNA to the plastid genome through homologous recombination (U.S. Pat. No. 5,451,513, U.S. Pat. No. 5,545,818, U.S. Pat. No. 5,877,402, U.S. Pat. No. 5,932,479, and WO 99/05265).

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions that influence the physiological state of the recipient cells and that may therefore influence transformation and integration efficiencies. For example, the osmotic state, tissue hydration and the subculture stage, or cell cycle of the recipient cells, may be adjusted for optimum transformation. The execution of other routine adjustments will be known to those of skill in the art in light of the present disclosure.

Transformation of plant protoplasts can be achieved using methods based on calcium phosphate precipitation, polyethylene glycol treatment, electroporation, and combinations of these treatments. Application of these systems to different plant varieties depends upon the ability to regenerate that particular plant strain from protoplasts. Illustrative methods for the regeneration of cereals from protoplasts are described (Fujimura et al., 1985; Toriyama et al., 1986; Abdullah et al., 1986).

Other methods of cell transformation can also be used and include but are not limited to the introduction of DNA into plants by direct DNA transfer into pollen, by direct injection of DNA into reproductive organs of a plant, or by direct injection of DNA into the cells of immature embryos followed by the rehydration of desiccated embryos.

The regeneration, development, and cultivation of plants from single plant protoplast transformants or from various transformed explants is well known in the art (Weissbach et al., In: Methods for Plant Molecular Biology, Academic Press, San Diego, Calif., (1988)). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polynucleotide is cultivated using methods well known to one skilled in the art.

Methods for transforming dicots, primarily by use of *Agrobacterium tumefaciens*, and obtaining transgenic plants have been published for cotton (U.S. Pat. No. 5,004,863, U.S. Pat. No. 5,159,135, U.S. Pat. No. 5,518,908), soybean (U.S. Pat. No. 5,569,834, U.S. Pat. No. 5,416,011), *Brassica* (U.S. Pat. No. 5,463,174), peanut (Cheng et al., 1996), and pea (Grant et al., 1995).

Methods for transformation of cereal plants such as wheat and barley for introducing genetic variation into the plant by introduction of an exogenous nucleic acid and for regeneration of plants from protoplasts or immature plant embryos are well known in the art, see for example, CA 2,092,588, AU 61781/94, AU 667939, U.S. Pat. No. 6,100,447, PCT/US97/10621, U.S. Pat. No. 5,589,617, U.S. Pat. No. 6,541,257, and other methods are set out in WO 99/14314. Preferably, transgenic wheat or barley plants are produced by *Agrobacterium tumefaciens* mediated transformation procedures. Vectors carrying the desired polynucleotide may be introduced into regenerable wheat cells of tissue cultured plants or explants, or suitable plant systems such as protoplasts.

The regenerable wheat cells are preferably from the scutellum of immature embryos, mature embryos, callus derived from these, or the meristematic tissue.

To confirm the presence of the transgenes in transgenic cells and plants, a polymerase chain reaction (PCR) amplification or Southern blot analysis can be performed using methods known to those skilled in the art. Expression products of the transgenes can be detected in any of a variety of ways, depending upon the nature of the product, and include Western blot and enzyme assay. One particularly useful way to quantitate protein expression and to detect replication in different plant tissues is to use a reporter gene such as GUS. Once transgenic plants have been obtained, they may be grown to produce plant tissues or parts having the desired phenotype. The plant tissue or plant parts, may be harvested, and/or the seed collected. The seed may serve as a source for growing additional plants with tissues or parts having the desired characteristics.

A transgenic plant formed using *Agrobacterium* or other transformation methods typically contains a single genetic locus on one chromosome. Such transgenic plants can be referred to as being hemizygous for the added gene(s). More preferred is a transgenic plant that is homozygous for the added gene(s), that is, a transgenic plant that contains two added genes, one gene at the same locus on each chromosome of a chromosome pair. A homozygous transgenic plant can be obtained by self-fertilising a hemizygous transgenic plant, germinating some of the seed produced and analyzing the resulting plants for the gene of interest.

It is also to be understood that two different transgenic plants that contain two independently segregating exogenous genes or loci can also be crossed (mated) to produce offspring that contain both sets of genes or loci. Selfing of appropriate F1 progeny can produce plants that are homozygous for both exogenous genes or loci. Back-crossing to a parental plant and out-crossing with a non-transgenic plant are also contemplated, as is vegetative propagation. Descriptions of other breeding methods that are commonly used for different traits and crops can be found in Fehr, In: Breeding Methods for Cultivar Development, Wilcox J. ed., American Society of Agronomy, Madison Wis. (1987).

Tilling

In one embodiment, TILLING (Targeting Induced Local Lesions IN Genomes) can be used to produce plants in which endogenous genes are knocked out, for example genes encoding a DGAT, sn-1 glycerol-3-phosphate acyltransferase (GPAT), 1-acyl-glycerol-3-phosphate acyltransferase (LPAAT), acyl-CoA:lysophosphatidylcholine acyltransferase (LPCAT), phosphatidic acid phosphatase (PAP), or a combination of two or more thereof.

In a first step, introduced mutations such as novel single base pair changes are induced in a population of plants by treating seeds (or pollen) with a chemical mutagen, and then advancing plants to a generation where mutations will be stably inherited. DNA is extracted, and seeds are stored from all members of the population to create a resource that can be accessed repeatedly over time.

For a TILLING assay, PCR primers are designed to specifically amplify a single gene target of interest. Specificity is especially important if a target is a member of a gene family or part of a polyploid genome. Next, dye-labeled primers can be used to amplify PCR products from pooled DNA of multiple individuals. These PCR products are denatured and reannealed to allow the formation of mismatched base pairs. Mismatches, or heteroduplexes, represent both naturally occurring single nucleotide polymorphisms (SNPs) (i.e., several plants from the population are likely to carry the same polymorphism) and induced SNPs (i.e., only rare individual plants are likely to display the mutation). After heteroduplex formation, the use of an endonuclease, such as Cell, that recognizes and cleaves mismatched DNA is the key to discovering novel SNPs within a TILLING population.

Using this approach, many thousands of plants can be screened to identify any individual with a single base change as well as small insertions or deletions (1-30 bp) in any gene or specific region of the genome. Genomic fragments being assayed can range in size anywhere from 0.3 to 1.6 kb. At 8-fold pooling, 1.4 kb fragments (discounting the ends of fragments where SNP detection is problematic due to noise) and 96 lanes per assay, this combination allows up to a million base pairs of genomic DNA to be screened per single assay, making TILLING a high-throughput technique.

TILLING is further described in Slade and Knauf (2005), and Henikoff et al. (2004).

In addition to allowing efficient detection of mutations, high-throughput TILLING technology is ideal for the detection of natural polymorphisms. Therefore, interrogating an unknown homologous DNA by heteroduplexing to a known sequence reveals the number and position of polymorphic sites. Both nucleotide changes and small insertions and deletions are identified, including at least some repeat number polymorphisms. This has been called Ecotilling (Comai et al., 2004).

Each SNP is recorded by its approximate position within a few nucleotides. Thus, each haplotype can be archived based on its mobility. Sequence data can be obtained with a relatively small incremental effort using aliquots of the same amplified DNA that is used for the mismatch-cleavage assay. The left or right sequencing primer for a single reaction is chosen by its proximity to the polymorphism. Sequencher software performs a multiple alignment and discovers the base change, which in each case confirmed the gel band.

Ecotilling can be performed more cheaply than full sequencing, the method currently used for most SNP discovery. Plates containing arrayed ecotypic DNA can be screened rather than pools of DNA from mutagenized plants. Because detection is on gels with nearly base pair resolution and background patterns are uniform across lanes, bands that are of identical size can be matched, thus discovering and genotyping SNPs in a single step. In this way, ultimate sequencing of the SNP is simple and efficient, made more so by the fact that the aliquots of the same PCR products used for screening can be subjected to DNA sequencing.

Enhancing Exogenous RNA Levels and Stabilized Expression

Post-transcriptional gene silencing (PTGS) is a nucleotide sequence-specific defense mechanism that can target both cellular and viral mRNAs for degradation. PTGS occurs in plants or fungi stably or transiently transformed with a recombinant polynucleotide(s) and results in the reduced accumulation of RNA molecules with sequence similarity to the introduced polynucleotide.

RNA molecule levels can be increased, and/or RNA molecule levels stabilized over numerous generations, by limiting the expression of a silencing suppressor in a storage organ of a plant or part thereof. As used herein, a "silencing suppressor" is any polynucleotide or polypeptide that can be expressed in a plant cell that enhances the level of expression product from a different transgene in the plant cell, particularly, over repeated generations from the initially transformed plant. In an embodiment, the silencing suppressor is a viral silencing suppressor or mutant thereof. A large number of viral silencing suppressors are known in the art and include, but are not limited to P19, V2, P38, Pe-Po and RPV-P0. Examples of suitable viral silencing suppressors include those described in WO 2010/057246. A silencing suppressor may be stably expressed in a plant or part thereof of the present invention.

As used herein, the term "stably expressed" or variations thereof refers to the level of the RNA molecule being essentially the same or higher in progeny plants over repeated generations, for example, at least three, at least five, or at least ten generations, when compared to corresponding plants lacking the exogenous polynucleotide encoding the silencing suppressor. However, this term(s) does not exclude the possibility that over repeated generations there is some loss of levels of the RNA molecule when compared to a previous generation, for example, not less than a 10% loss per generation.

The suppressor can be selected from any source e.g. plant, viral, mammal, etc.

The suppressor may be, for example:
flock house virus B2,
pothos latent virus P14,
pothos latent virus AC2,
African cassaya mosaic virus AC4,
bhendi yellow vein mosaic disease C2,
bhendi yellow vein mosaic disease C4,
bhendi yellow vein mosaic disease βC1,
tomato chlorosis virus p22,
tomato chlorosis virus CP,
tomato chlorosis virus CPm,
tomato golden mosaic virus AL2,
tomato leaf curl Java virus βC1,
tomato yellow leaf curl virus V2,
tomato yellow leaf curl virus-China C2,
tomato yellow leaf curl China virus Y10 isolate $3C_1$,
tomato yellow leaf curl Israeli isolate V2,
mungbean yellow mosaic virus-Vigna AC2,
hibiscus chlorotic ringspot virus CP,
turnip crinkle virus P38,
turnip crinkle virus CP,
cauliflower mosaic virus P6,
beet yellows virus p21,
citrus tristeza virus p20,
citrus tristeza virus p23,
citrus tristeza virus CP,
cowpea mosaic virus SCP,
sweet potato chlorotic stunt virus p22,
cucumber mosaic virus 2b,
tomato aspermy virus HC-Pro,
beet curly top virus L2,
soil borne wheat mosaic virus 19K,
barley stripe mosaic virus Gammab,
*poa* semilatent virus Gammab,
peanut clump pecluvirus P15,
rice dwarf virus Pns 10,
curubit aphid borne yellows virus P0,
beet western yellows virus P0,
potato virus X P25,
cucumber vein yellowing virus Plb,
plum pox virus HC-Pro,
sugarcane mosaic virus HC-Pro,
potato virus Y strain HC-Pro,
tobacco etch virus P1/HC-Pro,
turnip mosaic virus P1/HC-Pro,
cocksfoot mottle virus P1,
cocksfoot mottle virus-Norwegian isolate P1,
rice yellow mottle virus P1,
rice yellow mottle virus-Nigerian isolate P1,
rice hoja blanca virus NS3,
rice stripe virus NS3,
crucifer infecting tobacco mosaic virus 126K,
crucifer infecting tobacco mosaic virus p122,
tobacco mosaic virus p122,
tobacco mosaic virus 126,
tobacco mosaic virus 130K,
tobacco rattle virus 16K,
tomato bushy stunt virus P19,
tomato spotted wilt virus NSs,
apple chlorotic leaf spot virus P50,
grapevine virus A p10, grapevine leafroll associated virus-2 homolog of BYV p21, as well as variants/mutants thereof. The list above provides the virus from which the suppressor can be obtained and the protein (e.g., B2, P14, etc,), or coding region designation for the suppressor from each particular virus.

Multiple copies of a suppressor may be used. Different suppressors may be used together (e.g., in tandem).

Essentially any RNA molecule which is desirable to be expressed in a plant storage organ can be co-expressed with the silencing suppressor. The RNA molecule may influence an agronomic trait, insect resistance, disease resistance, herbicide resistance, sterility, grain characteristics, and the like. The encoded polypeptides may be involved in metabolism of lipid, starch, carbohydrates, nutrients, etc., or may be responsible for the synthesis of proteins, peptides, lipids, waxes, starches, sugars, carbohydrates, flavors, odors, toxins, carotenoids. hormones, polymers, flavonoids, storage proteins, phenolic acids, alkaloids, lignins, tannins, celluloses, glycoproteins, glycolipids, etc.

In a particular example, the plants produced increased levels of enzymes for lipid production in plants such as *Brassicas*, for example oilseed rape or sunflower, safflower, flax, cotton, soya bean or maize.

Production of Non-Polar Lipids

Techniques that are routinely practiced in the art can be used to extract, process, purify and analyze the non-polar lipids produced by cells, organisms or parts thereof of the instant invention. Such techniques are described and explained throughout the literature in sources such as, Fereidoon Shahidi, Current Protocols in Food Analytical Chemistry, John Wiley & Sons, Inc. (2001) D1.1.1-D1.1.11, and Perez-Vich et al. (1998).

Production of Seedoil

Typically, plant seeds are cooked, pressed, and/or extracted to produce crude seedoil, which is then degummed, refined, bleached, and deodorized. Generally, techniques for crushing seed are known in the art. For example, oilseeds can be tempered by spraying them with water to raise the moisture content to, for example, 8.5%, and flaked using a smooth roller with a gap setting of 0.23 to 0.27 mm. Depending on the type of seed, water may not be added prior to crushing. Application of heat deactivates enzymes, facilitates further cell rupturing, coalesces the lipid droplets, and agglomerates protein particles, all of which facilitate the extraction process.

The majority of the seedoil is released by passage through a screw press. Cakes expelled from the screw press are then solvent extracted for example, with hexane, using a heat traced column. Alternatively, crude seedoil produced by the pressing operation can be passed through a settling tank with a slotted wire drainage top to remove the solids that are expressed with the seedoil during the pressing operation. The clarified seedoil can be passed through a plate and frame filter to remove any remaining fine solid particles. If desired, the seedoil recovered from the extraction process can be combined with the clarified seedoil to produce a blended crude seedoil.

Once the solvent is stripped from the crude seedoil, the pressed and extracted portions are combined and subjected to normal lipid processing procedures (i.e., degumming, caustic refining, bleaching, and deodorization). Degumming can be performed by addition of concentrated phosphoric acid to the crude seedoil to convert non-hydratable phosphatides to a hydratable form, and to chelate minor metals that are present. Gum is separated from the seedoil by centrifugation. The seedoil can be refined by addition of a sufficient amount of a sodium hydroxide solution to titrate all of the fatty acids and removing the soaps thus formed.

Deodorization can be performed by heating the seedoil to 260° C. under vacuum, and slowly introducing steam into the seedoil at a rate of about 0.1 ml/minute/100 ml of seedoil. After about 30 minutes of sparging, the seedoil is allowed to cool under vacuum. The seedoil is typically transferred to a glass container and flushed with argon before being stored under refrigeration. If the amount of seedoil is limited, the seedoil can be placed under vacuum for example, in a Parr reactor and heated to 260° C. for the same length of time that it would have been deodorized. This treatment improves the colour of the seedoil and removes a majority of the volatile substances.

Plant Biomass for the Production of Lipid

Parts of plants involved in photosynthesis (e.g., and stems and leaves of higher plants and aquatic plants such as algae) can also be used to produce lipid. Independent of the type of plant, there are several methods for extracting lipids from green biomass. One way is physical extraction, which often does not use solvent extraction. It is a "traditional" way using several different types of mechanical extraction. Expeller pressed extraction is a common type, as are the screw press and ram press extraction methods. The amount of lipid extracted using these methods varies widely, depending upon the plant material and the mechanical process employed. Mechanical extraction is typically less efficient than solvent extraction described below.

In solvent extraction, an organic solvent (e.g., hexane) is mixed with at least the genetically modified plant green biomass, preferably after the green biomass is dried and ground. Of course, other parts of the plant besides the green biomass (e.g., lipid-containing seeds) can be ground and mixed in as well. The solvent dissolves the lipid in the biomass and the like, which solution is then separated from the biomass by mechanical action (e.g., with the pressing processes above). This separation step can also be performed by filtration (e.g., with a filter press or similar device) or centrifugation etc. The organic solvent can then be separated from the non-polar lipid (e.g., by distillation). This second separation step yields non-polar lipid from the plant and can yield a re-usable solvent if one employs conventional vapor recovery.

Production of Algal Fuel

Algaculture is a form of aquaculture involving the farming of species of algae (including microalgae, also referred to as phytoplankton, microphytes, or planktonic algae, and macroalgae, commonly known as seaweed). Species of algae useful in the present invention include, for example, *Chlamydomonas* sp. (for example, *Chlomydomonas reinhardtii*), *Dunaliella* sp., *Haematococcus* sp., *Chlorella* sp., *Thraustochytrium* sp., *Schizochytrium* sp., and *Volvox* sp.

Commercial and industrial algae cultivation has numerous uses, including production of food ingredients, food, and algal fuel.

Mono or mixed algal cultures can be cultured in open-ponds (such as raceway-type ponds and lakes) or photobioreactors.

Algae can be harvested using microscreens, by centrifugation, by flocculation (using for example, chitosan, alum and ferric chloride) and by froth flotation. Interrupting the carbon dioxide supply can cause algae to flocculate on its own, which is called "autoflocculation". In froth flotation, the cultivator aerates the water into a froth, and then skims the algae from the top. Ultrasound and other harvesting methods are currently under development.

Lipid may be separated from the algae by mechanical crushing. When algae is dried it retains its lipid content, which can then be "pressed" out with an oil press. Since different strains of algae vary widely in their physical attributes, various press configurations (screw, expeller, piston, etc.) work better for specific algae types.

Osmotic shock is sometimes used to release cellular components such as lipid from algae. Osmotic shock is a sudden reduction in osmotic pressure and can cause cells in a solution to rupture.

Ultrasonic extraction can accelerate extraction processes, in particular enzymatic extraction processes employed to extract lipid from algae. Ultrasonic waves are used to create cavitation bubbles in a solvent material. When these bubbles collapse near the cell walls, the resulting shock waves and liquid jets cause those cells walls to break and release their contents into a solvent.

Chemical solvents (for example, hexane, benzene, petroleum ether) are often used in the extraction of lipids from algae. Soxhlet extraction can be use to extract lipids from algae through repeated washing, or percolation, with an organic solvent under reflux in a special glassware.

Enzymatic extraction may be used to extract lipids from algae. Ezymatic extraction uses enzymes to degrade the cell walls with water acting as the solvent. The enzymatic extraction can be supported by ultrasonication.

Supercritical $CO_2$ can also be used as a solvent. In this method, $CO_2$ is liquefied under pressure and heated to the point that it becomes supercritical (having properties of both a liquid and a gas), allowing it to act as a solvent.

Fermentation Processes for Lipid Production

As used herein, the term the "fermentation process" refers to any fermentation process or any process comprising a fermentation step. A fermentation process includes, without limitation, fermentation processes used to produce alcohols (e.g., ethanol, methanol, butanol), organic acids (e.g., citric acid, acetic acid, itaconic acid, lactic acid, gluconic acid), ketones (e.g., acetone), amino acids (e.g., glutamic acid), gases (e.g., $H_2$ and $CO_2$), antibiotics (e.g., penicillin and tetracycline), enzymes, vitamins (e.g., riboflavin, beta-carotene), and hormones. Fermentation processes also include fermentation processes used in the consumable alcohol industry (e.g., beer and wine), dairy industry (e.g., fermented dairy products), leather industry and tobacco industry. Preferred fermentation processes include alcohol fermentation processes, as are well known in the art. Preferred fermentation processes are anaerobic fermentation processes, as are well known in the art. Suitable fermenting cells, typically microorganisms that are able to ferment, that is, convert, sugars such as glucose or maltose, directly or indirectly into the desired fermentation product. Examples of fermenting microorganisms include fungal organisms such as yeast, preferably an oleaginous organism. As used herein, an "oleaginous organism" is one which accumulates at least 25% of its dry weight as triglycerides. As used herein, "yeast" includes *Saccharomyces* spp., *Saccharomyces cerevisiae*, *Saccharomyces carlbergensis*, *Candida* spp., *Kluveromyces* spp., *Pichia* spp., *Hansenula* spp., *Trichoderma* spp., *Lipomyces starkey*, and *Yarrowia lipolytica*. Preferred yeast include *Yarrowia lipolytica* or other oleaginous yeasts and strains of the *Saccharomyces* spp., and in particular, *Saccharomyces cerevisiae*.

The transgenic microorganism is preferably grown under conditions that optimize activity of fatty acid biosynthetic genes and acyltransferase genes. This leads to production of the greatest and the most economical yield of lipid. In general, media conditions that may be optimized include the type and amount of carbon source, the type and amount of nitrogen source, the carbon-to-nitrogen ratio, the oxygen level, growth temperature, pH, length of the biomass production phase, length of the lipid accumulation phase and the time of cell harvest.

Fermentation media must contain a suitable carbon source. Suitable carbon sources may include, but are not limited to: monosaccharides (e.g., glucose, fructose), disaccharides (e.g., lactose, sucrose), oligosaccharides, polysaccharides (e.g., starch, cellulose or mixtures thereof), sugar alcohols (e.g., glycerol) or mixtures from renewable feedstocks (e.g., cheese whey permeate, cornsteep liquor, sugar beet molasses, barley malt). Additionally, carbon sources may include alkanes, fatty acids, esters of fatty acids, monoglycerides, diglycerides, triglycerides, phospholipids and various commercial sources of fatty acids including vegetable oils (e.g., soybean oil) and animal fats. Additionally, the carbon substrate may include one-carbon substrates (e.g., carbon dioxide, methanol, formaldehyde, formate, carbon-containing amines) for which metabolic conversion into key biochemical intermediates has been demonstrated. Hence it is contemplated that the source of carbon utilized in the present invention may encompass a wide variety of carbon-containing substrates and will only be limited by the choice of the host microorganism. Although all of the above mentioned carbon substrates and mixtures thereof are expected to be suitable in the present invention, preferred carbon substrates are sugars and/or fatty acids. Most preferred is glucose and/or fatty acids containing between 10-22 carbons.

Nitrogen may be supplied from an inorganic (e.g., $(NH_4)_2SO_4$) or organic source (e.g., urea, glutamate). In addition to appropriate carbon and nitrogen sources, the fermentation media may also contain suitable minerals, salts, cofactors, buffers, vitamins and other components known to those skilled in the art suitable for the growth of the microorganism and promotion of the enzymatic pathways necessary for lipid production.

A suitable pH range for the fermentation is typically between about pH 4.0 to pH 8.0, wherein pH 5.5 to pH 7.0 is preferred as the range for the initial growth conditions. The fermentation may be conducted under aerobic or anaerobic conditions, wherein microaerobic conditions are preferred.

Typically, accumulation of high levels of lipid in the cells of oleaginous microorganisms requires a two-stage process, since the metabolic state must be "balanced" between growth and synthesis/storage of fats. Thus, most preferably, a two-stage fermentation process is necessary for the production of lipids in microorganisms. In this approach, the first stage of the fermentation is dedicated to the generation and accumulation of cell mass and is characterized by rapid cell growth and cell division. In the second stage of the fermentation, it is preferable to establish conditions of nitrogen deprivation in the culture to promote high levels of lipid accumulation. The effect of this nitrogen deprivation is to reduce the effective concentration of AMP in the cells, thereby reducing the activity of the NAD-dependent isocitrate dehydrogenase of mitochondria, When this occurs, citric acid will accumulate, thus forming abundant pools of acetyl-CoA in the cytoplasm and priming fatty acid synthesis. Thus, this phase is characterized by the cessation of cell division followed by the synthesis of fatty acids and accumulation of TAGs.

Although cells are typically grown at about 30° C., some studies have shown increased synthesis of unsaturated fatty acids at lower temperatures. Based on process economics, this temperature shift should likely occur after the first phase of the two-stage fermentation, when the bulk of the microorganism's growth has occurred.

It is contemplated that a variety of fermentation process designs may be applied, where commercial production of lipids using the instant nucleic acids is desired. For example, commercial production of lipid from a recombinant microbial host may be produced by a batch, fed-batch or continuous fermentation process.

A batch fermentation process is a closed system wherein the media composition is set at the beginning of the process and not subject to further additions beyond those required for maintenance of pH and oxygen level during the process. Thus, at the beginning of the culturing process the media is inoculated with the desired organism and growth or metabolic activity is permitted to occur without adding additional substrates (i.e., carbon and nitrogen sources) to the medium. In batch processes the metabolite and biomass compositions of the system change constantly up to the time the culture is terminated. In a typical batch process, cells moderate through a static lag phase to a high-growth log phase and finally to a stationary phase, wherein the growth rate is diminished or halted. Left untreated, cells in the stationary phase will eventually die. A variation of the standard batch process is the fed-batch process, wherein the substrate is continually added to the fermentor over the course of the fermentation process. A fed-batch process is also suitable in the present invention. Fed-batch processes are useful when catabolite repression is apt to inhibit the metabolism of the cells or where it is desirable to have limited amounts of substrate in the media at any one time. Measurement of the substrate concentration in fed-batch systems is difficult and therefore may be estimated on the basis of the changes of measurable factors such as pH, dissolved oxygen and the partial pressure of waste gases (e.g., $CO_2$). Batch and fed-batch culturing methods are common and well known in the art and examples may be found in Brock, In Biotechnology: A Textbook of Industrial Microbiology, 2.sup.nd ed., Sinauer Associates, Sunderland, Mass., (1989); or Deshpande and Mukund (1992).

Commercial production of lipid using the instant cells may also be accomplished by a continuous fermentation process, wherein a defined media is continuously added to a bioreactor while an equal amount of culture volume is removed simultaneously for product recovery. Continuous cultures generally maintain the cells in the log phase of growth at a constant cell density. Continuous or semi-continuous culture methods permit the modulation of one factor or any number of factors that affect cell growth or end product concentration. For example, one approach may limit the carbon source and allow all other parameters to moderate metabolism. In other systems, a number of factors affecting growth may be altered continuously while the cell concentration, measured by media turbidity, is kept constant. Continuous systems strive to maintain steady state growth and thus the cell growth rate must be balanced against cell loss due to media being drawn off the culture. Methods of modulating nutrients and growth factors for continuous culture processes, as well as techniques for maximizing the rate of product formation, are well known in the art of industrial microbiology and a variety of methods are detailed by Brock, supra.

Fatty acids, including PUFAs, may be found in the host microorganism as free fatty acids or in esterified forms such as acylglycerols, phospholipids, sulfolipids or glycolipids, and may be extracted from the host cell through a variety of means well-known in the art.

In general, means for the purification of fatty acids, including PUFAs, may include extraction with organic solvents, sonication, supercritical fluid extraction (e.g., using carbon dioxide), saponification and physical means such as presses, or combinations thereof. Of particular interest is extraction with methanol and chloroform in the presence of water (Bligh and Dyer, 1959). Where desirable, the aqueous layer can be acidified to protonate negatively-charged moieties and thereby increase partitioning of desired products into the organic layer. After extraction, the organic solvents can be removed by evaporation under a stream of nitrogen. When isolated in conjugated forms, the products may be enzymatically or chemically cleaved to release the free fatty acid or a less complex conjugate of interest, and can then be subject to further manipulations to produce a desired end product. Desirably, conjugated forms of fatty acids are cleaved with potassium hydroxide.

If further purification is necessary, standard methods can be employed. Such methods may include extraction, treatment with urea, fractional crystallization, HPLC, fractional distillation, silica gel chromatography, high-speed centrifugation or distillation, or combinations of these techniques. Protection of reactive groups such as the acid or alkenyl groups, may be done at any step through known techniques (e.g., alkylation, iodination). Methods used include methylation of the fatty acids to produce methyl esters. Similarly, protecting groups may be removed at any step. Desirably, purification of fractions containing GLA, STA, ARA, DHA and EPA may be accomplished by treatment with urea and/or fractional distillation.

Uses of Lipids

The lipids produced by the methods described have a variety of uses. In some embodiments, the lipids are used as food oils. In other embodiments, the lipids are refined and used as lubricants or for other industrial uses such as the synthesis of plastics. In some preferred embodiments, the lipids are refined to produce biodiesel.

Biodiesel

The production of biodiesel, or alkyl esters, is well known. There are three basic routes to ester production from lipids: 1) Base catalysed transesterification of the lipid with alcohol; 2) Direct acid catalysed esterification of the lipid with methanol; and 3) Conversion of the lipid to fatty acids, and then to alkyl esters with acid catalysis.

In some preferred embodiments, the lipids are transesterified to produce methyl esters and glycerol. In some preferred embodiments, the lipids are reacted with an alcohol (such as methanol or ethanol) in the presence of a catalyst (potassium or sodium hydroxide) to produce alkyl esters. The alkyl esters can be used for biodiesel or blended with petroleum based fuels.

Feedstuffs

The present invention includes compositions which can be used as feedstuffs. For purposes of the present invention, "feedstuffs" include any food or preparation for human or animal consumption (including for enteral and/or parenteral consumption) which when taken into the body: (1) serve to nourish or build up tissues or supply energy, and/or (2) maintain, restore or support adequate nutritional status or metabolic function. Feedstuffs of the invention include nutritional compositions for babies and/or young children.

Feedstuffs of the invention comprise for example, a cell of the invention, a plant of the invention, the plant part of the invention, the seed of the invention, an extract of the invention, the product of a method of the invention, the product of a fermentation process of the invention, or a composition along with a suitable carrier(s). The term "carrier" is used in its broadest sense to encompass any component which may or may not have nutritional value. As the person skilled in the art will appreciate, the carrier must be suitable for use (or used in a sufficiently low concentration) in a feedstuff, such that it does not have deleterious effect on an organism which consumes the feedstuff.

The feedstuff of the present invention comprises a lipid produced directly or indirectly by use of the methods, cells or organisms disclosed herein. The composition may either be in a solid or liquid form. Additionally, the composition may include edible macronutrients, vitamins, and/or minerals in amounts desired for a particular use. The amounts of these ingredients will vary depending on whether the composition is intended for use with normal individuals or for use with individuals having specialized needs such as individuals suffering from metabolic disorders and the like.

Examples of suitable carriers with nutritional value include, but are not limited to, macronutrients such as edible fats, carbohydrates and proteins. Examples of such edible fats include, but are not limited to, coconut oil, borage oil, fungal oil, black current oil, soy oil, and mono- and di-glycerides. Examples of such carbohydrates include, but are not limited to, glucose, edible lactose, and hydrolyzed starch. Additionally, examples of proteins which may be utilized in the nutritional composition of the invention include, but are not limited to, soy proteins, electrodialysed whey, electrodialysed skim milk, milk whey, or the hydrolysates of these proteins.

With respect to vitamins and minerals, the following may be added to the feedstuff compositions of the present invention, calcium, phosphorus, potassium, sodium, chloride, magnesium, manganese, iron, copper, zinc, selenium, iodine, and vitamins A, E, D, C, and the B complex. Other such vitamins and minerals may also be added.

The components utilized in the feedstuff compositions of the present invention can be of semi-purified or purified origin. By semi-purified or purified is meant a material which has been prepared by purification of a natural material or by de novo synthesis.

A feedstuff composition of the present invention may also be added to food even when supplementation of the diet is not required. For example, the composition may be added to food of any type, including, but not limited to, margarine, modified butter, cheeses, milk, yogurt, chocolate, candy, snacks, salad oils, cooking oils, cooking fats, meats, fish and beverages.

The genus *Saccharomyces* spp is used in both brewing of beer and wine making and also as an agent in baking, particularly bread. Yeast is a major constituent of vegetable extracts. Yeast is also used as an additive in animal feed. It will be apparent that genetically modified yeast strains can be provided which are adapted to synthesize lipid as described herein. These yeast strains can then be used in food stuffs and in wine and beer making to provide products which have enhanced lipid content.

Additionally, lipid produced in accordance with the present invention or host cells transformed to contain and express the subject genes may also be used as animal food supplements to alter an animal's tissue or milk fatty acid composition to one more desirable for human or animal consumption. Examples of such animals include sheep, cattle, horses and the like.

Furthermore, feedstuffs of the invention can be used in aquaculture to increase the levels of fatty acids in fish for human or animal consumption.

Preferred feedstuffs of the invention are the plants, seed and other plant parts such as leaves, fruits and stems which may be used directly as food or feed for humans or other animals. For example, animals may graze directly on such plants grown in the field, or be fed more measured amounts in controlled feeding. The invention includes the use of such plants and plant parts as feed for increasing the polyunsaturated fatty acid levels in humans and other animals.

Compositions

The present invention also encompasses compositions, particularly pharmaceutical compositions, comprising one or more lipids produced using the methods of the invention.

A pharmaceutical composition may comprise one or more of the lipids, in combination with a standard, well-known, non-toxic pharmaceutically-acceptable carrier, adjuvant or vehicle such as phosphate-buffered saline, water, ethanol, polyols, vegetable oils, a wetting agent, or an emulsion such as a water/oil emulsion. The composition may be in either a liquid or solid form. For example, the composition may be in the form of a tablet, capsule, ingestible liquid, powder, topical ointment or cream. Proper fluidity can be maintained for example, by the maintenance of the required particle size in the case of dispersions and by the use of surfactants. It may also be desirable to include isotonic agents for example, sugars, sodium chloride, and the like. Besides such inert diluents, the composition can also include adjuvants such as wetting agents, emulsifying and suspending agents, sweetening agents, flavoring agents and perfuming agents.

Suspensions, in addition to the active compounds, may comprise suspending agents such as ethoxylated isostearyl alcohols, polyoxyethylene sorbitol and sorbitan esters, microcrystalline cellulose, aluminum metahydroxide, bentonite, agar-agar, and tragacanth, or mixtures of these substances.

Solid dosage forms such as tablets and capsules can be prepared using techniques well known in the art. For example, lipid produced in accordance with the present invention can be tableted with conventional tablet bases such as lactose, sucrose, and cornstarch in combination with binders such as acacia, cornstarch or gelatin, disintegrating agents such as potato starch or alginic acid, and a lubricant such as stearic acid or magnesium stearate. Capsules can be prepared by incorporating these excipients into a gelatin capsule along with antioxidants and the relevant lipid(s).

For intravenous administration, the lipids produced in accordance with the present invention or derivatives thereof may be incorporated into commercial formulations.

A typical dosage of a particular fatty acid is from 0.1 mg to 20 g, taken from one to five times per day (up to 100 g daily) and is preferably in the range of from about 10 mg to about 1, 2, 5, or 10 g daily (taken in one or multiple doses). As known in the art, a minimum of about 300 mg/day of fatty acid, especially polyunsaturated fatty acid, is desirable. However, it will be appreciated that any amount of fatty acid will be beneficial to the subject.

Possible routes of administration of the pharmaceutical compositions of the present invention include for example, enteral and parenteral. For example, a liquid preparation may be administered orally. Additionally, a homogenous mixture can be completely dispersed in water, admixed under sterile conditions with physiologically acceptable diluents, preservatives, buffers or propellants to form a spray or inhalant.

The dosage of the composition to be administered to the subject may be determined by one of ordinary skill in the art and depends upon various factors such as weight, age, overall health, past history, immune status, etc., of the subject.

Additionally, the compositions of the present invention may be utilized for cosmetic purposes. The compositions may be added to pre-existing cosmetic compositions, such that a mixture is formed, or a fatty acid produced according to the invention may be used as the sole "active" ingredient in a cosmetic composition.

Polypeptides

The terms "polypeptide" and "protein" are generally used interchangeably.

A polypeptide or class of polypeptides may be defined by the extent of identity (% identity) of its amino acid sequence to a reference amino acid sequence, or by having a greater % identity to one reference amino acid sequence than to another. The % identity of a polypeptide to a reference amino acid sequence is typically determined by GAP analysis (Needleman and Wunsch, 1970; GCG program) with parameters of a gap creation penalty=5, and a gap extension penalty=0.3. The query sequence is at least 100 amino acids in length and the GAP analysis aligns the two sequences over a region of at least 100 amino acids. Even more preferably, the query sequence is at least 250 amino acids in length and the GAP analysis aligns the two sequences over a region of at least 250 amino acids. Even more preferably, the GAP analysis aligns two sequences over their entire length. The polypeptide or class of polypeptides may have the same enzymatic activity as, or a different activity than, or lack the activity of, the reference polypeptide. Preferably, the polypeptide has an enzymatic activity of at least 10% of the activity of the reference polypeptide.

As used herein a "biologically active fragment" is a portion of a polypeptide of the invention which maintains a defined activity of a full-length reference polypeptide for example, MGAT activity. Biologically active fragments as used herein exclude the full-length polypeptide. Biologically active fragments can be any size portion as long as they maintain the defined activity. Preferably, the biologically active fragment maintains at least 10% of the activity of the full length polypeptide.

With regard to a defined polypeptide or enzyme, it will be appreciated that % identity figures higher than those provided herein will encompass preferred embodiments. Thus, where applicable, in light of the minimum % identity figures, it is preferred that the polypeptide/enzyme comprises an amino acid sequence which is at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to the relevant nominated SEQ ID NO.

Amino acid sequence mutants of the polypeptides defined herein can be prepared by introducing appropriate nucleotide changes into a nucleic acid defined herein, or by in vitro synthesis of the desired polypeptide. Such mutants include for example, deletions, insertions, or substitutions of residues within the amino acid sequence. A combination of deletions, insertions and substitutions can be made to arrive at the final construct, provided that the final polypeptide product possesses the desired characteristics.

Mutant (altered) polypeptides can be prepared using any technique known in the art, for example, using directed evolution or rathional design strategies (see below). Products derived from mutated/altered DNA can readily be screened using techniques described herein to determine if they possess acyltransferase activity, for example, MGAT, DGAT, or GPAT/phosphatase activity.

In designing amino acid sequence mutants, the location of the mutation site and the nature of the mutation will depend on characteristic(s) to be modified. The sites for mutation can be modified individually or in series for example, by (1) substituting first with conservative amino acid choices and then with more radical selections depending upon the results achieved, (2) deleting the target residue, or (3) inserting other residues adjacent to the located site.

Amino acid sequence deletions generally range from about 1 to 15 residues, more preferably about 1 to 10 residues and typically about 1 to 5 contiguous residues.

Substitution mutants have at least one amino acid residue in the polypeptide removed and a different residue inserted in its place. The sites of greatest interest for substitutional mutagenesis include sites identified as the active site(s). Other sites of interest are those in which particular residues obtained from various strains or species are identical. These positions may be important for biological activity. These sites, especially those falling within a sequence of at least three other identically conserved sites, are preferably substituted in a relatively conservative manner. Such conservative substitutions are shown in Table 1 under the heading of "exemplary substitutions".

In a preferred embodiment a mutant/variant polypeptide has only, or not more than, one or two or three or four conservative amino acid changes when compared to a naturally occurring polypeptide. Details of conservative amino acid changes are provided in Table 1. As the skilled person would be aware, such minor changes can reasonably be predicted not to alter the activity of the polypeptide when expressed in a recombinant cell.

TABLE 1

Exemplary substitutions.

| Original Residue | Exemplary Substitutions |
|---|---|
| Ala (A) | val; leu; ile; gly |
| Arg (R) | lys |
| Asn (N) | gln; his |
| Asp (D) | glu |
| Cys (C) | ser |
| Gln (Q) | asn; his |
| Glu (E) | asp |
| Gly (G) | pro, ala |
| His (H) | asn; gln |
| Ile (I) | leu; val; ala |
| Leu (L) | ile; val; met; ala; phe |
| Lys (K) | arg |
| Met (M) | leu; phe |
| Phe (F) | leu; val; ala |
| Pro (P) | gly |
| Ser (S) | thr |
| Thr (T) | ser |
| Trp (W) | tyr |
| Tyr (Y) | trp; phe |
| Val (V) | ile; leu; met; phe, ala |

Directed Evolution

In directed evolution, random mutagenesis is applied to a protein, and a selection regime is used to pick out variants that have the desired qualities, for example, increased acyltransferase activity. Further rounds of mutation and selection are then applied. A typical directed evolution strategy involves three steps:

1) Diversification: The gene encoding the protein of interest is mutated and/or recombined at random to create a large library of gene variants. Variant gene libraries can be constructed through error prone PCR (see, for example, Leung, 1989; Cadwell and Joyce, 1992), from pools of DNaseI digested fragments prepared from parental templates (Stemmer, 1994a; Stemmer, 1994b; Crameri et al., 1998; Coco et al., 2001) from degenerate oligonucleotides (Ness et al., 2002, Coco, 2002) or from mixtures of both, or even from undigested parental templates (Zhao et al. 1998; Eggert et al., 2005: Jezequek et al., 2008) and are usually assembled through PCR. Libraries can also be made from parental sequences recombined in vivo or in vitro by either homologous or non-homologous recombination (Ostermeier et al., 1999; Volkov et al., 1999; Sieber et al., 2001). Variant gene libraries can also be constructed by sub-cloning a gene of interest into a suitable vector, transforming the vector into a "mutator" strain such as the E. coli XL-1 red (Stratagene) and propagating the transformed bacteria for a suitable number of generations. Variant gene libraries can also be constructed by subjecting the gene of interest to DNA shuffling (i.e., in vitro homologous recombination of pools of selected mutant genes by random fragmentation and reassembly) as broadly described by Harayama (1998).

2) Selection: The library is tested for the presence of mutants (variants) possessing the desired property using a screen or selection. Screens enable the identification and isolation of high-performing mutants by hand, while selections automatically eliminate all nonfunctional mutants. A screen may involve screening for the presence of known conserved amino acid motifs. Alternatively, or in addition, a screen may involve expressing the mutated polynucleotide in a host organsim or part thereof and assaying the level of acyltransferase activity by, for example, quantifying the level of resultant product in lipid extracted from the organism or part thereof, and determining the level of product in the extracted lipid from the organsim or part thereof relative to a corresponding organism or part thereof lacking the mutated polynucleotide and optionally, expressing the parent (unmutated) polynucleotide. Alternatively, the screen may involve feeding the organism or part thereof labelled substrate and determining the level of substrate or product in the organism or part thereof relative to a corresponding organism or part thereof lacking the mutated polynucleotide and optionally, expressing the parent (unmutated) polynucleotide.

3) Amplification: The variants identified in the selection or screen are replicated many fold, enabling researchers to sequence their DNA in order to understand what mutations have occurred.

Together, these three steps are termed a "round" of directed evolution. Most experiments will entail more than one round. In these experiments, the "winners" of the previous round are diversified in the next round to create a new library. At the end of the experiment, all evolved protein or polynucleotide mutants are characterized using biochemical methods.

Rational Design

A protein can be designed rationally, on the basis of known information about protein structure and folding. This can be accomplished by design from scratch (de novo design) or by redesign based on native scaffolds (see, for example, Hallinga, 1997; and Lu and Berry, Protein Structure Design and Engineering, Handbook of Proteins 2, 1153-1157 (2007)). Protein design typically involves identifying sequences that fold into a given or target structure and can be accomplished using computer models. Computational protein design algorithms search the sequence-conformation space for sequences that are low in energy when folded to the target structure. Computational protein design algorithms use models of protein energetics to evaluate how mutations would affect a protein's structure and function. These energy functions typically include a combination of molecular mechanics, statistical (i.e. knowledge-based), and other empirical terms. Suitable available software includes IPRO (Interative Protein Redesign and Optimization), EGAD (A Genetic Algorithm for Protein Design), Rosetta Design, Sharpen, and Abalone.

Also included within the scope of the invention are polypeptides defined herein which are differentially modified during or after synthesis for example, by biotinylation, benzylation, glycosylation, acetylation, phosphorylation, amidation, derivatization by known protecting/blocking groups, proteolytic cleavage, linkage to an antibody molecule or other cellular ligand, etc. These modifications may serve to increase the stability and/or bioactivity of the polypeptide of the invention.

Identification of Acyltransferases

In one aspect, the invention provides a method for identifying a nucleic acid molecule encoding an acyltransferase having an increased ability to produce MAG, DAG and/or TAG in a cell.

The method comprises obtaining a cell comprising a nucleic acid molecule encoding an acyltransferase operably linked to a promoter which is active in the cell. The nucleic acid molecule may encode a naturally occurring acyltransferase such as MGAT, GPAT and/or DGAT, or a mutant(s) thereof. Mutants may be engineered using standard procedures in the art (see above) such as by performing random mutagenesis, targeted mutagenesis, or saturation mutagenesis on known genes of interest, or by subjecting different genes to DNA shuffling. For example, a polynucleotide comprising a sequence selected from any one of SEQ ID NOs: 1 to 44 which encodes a MGAT may be mutated and/or recombined at random to create a large library of gene variants (mutants) using for example, error-prone PCR and/or DNA shuffling. Mutants may be selected for further investigation on the basis that they comprise a conserved amino acid motif. For example, in the case of a candidate nucleic acid encoding a MGAT, a skilled person may determine whether it comprises a sequence as provided in SEQ ID NOs:220, 221, 222, 223, and/or 224 before testing whether the nucleic acid encodes a functional MGAT mutant (by for example, transfection into a host cell, such as a plant cell and assaying for acyltransferase (i.e., MGAT) activity as described herein). Direct PCR sequencing of the nucleic acid or a fragment thereof may be used to determine the exact nucleotide sequence and deduce the corresponding amino acid sequence and thereby identify conserved amino acid sequences. Degenerate primers based on conserved amino acid sequences may be used to direct PCR amplification. Degenerate primers can also be used as probes in DNA hybridization assays. Alternatively, the conserved amino acid sequence(s) may be detected in protein hybridization assays that utilize for example, an antibody that specifically binds to the conserved amino acid sequences(s), or a substrate that specifically binds to the conserved amino acid sequences(s) such as, for example, a lipid that binds FLXLXXXN (a putative neutral lipid binding domain; SEQ ID NO:224).

In one embodiment, the nucleic acid molecule comprises a sequence of nucleotides encoding a MGAT. The sequence of nucleotides may i) comprise a sequence selected from any one of SEQ ID NOs:1 to 44, ii) encode a polypeptide comprising amino acids having a sequence as provided in any one of SEQ ID NOs:45 to 82, or a biologically active fragment thereof, iii) be at least 50% identical to i) or ii), or iv) hybridize to any one of i) to iii) under stringent conditions. In another or additional embodiment, the nucleic acid molecule comprises a sequence of nucleotides encoding one or more conserved DGAT2 and/or MGAT1/2 amino acid sequences as provided in SEQ ID NOs:220, 221, 222, 223, and 224. In a preferred embodiment, the nucleic acid molecule comprises a sequence of nucleotides encoding the conserved amino acid sequences provided in SEQ ID NO:220 and/or SEQ ID NO:224.

In another embodiment, the nucleic acid molecule comprises a sequence of nucleotides encoding a GPAT, preferably a GPAT which has phosphatase activity. The sequence of nucleotides may i) comprise a sequence selected from any one of SEQ ID NOs:84 to 141, ii) encode a polypeptide comprising amino acids having a sequence as provided in any one of SEQ ID NOs:144 to 201, or a biologically active fragment thereof, iii) be at least 50% identical to i) or ii), or iv) hybridize to any one of i) to iii) under stringent conditions. In another or additional embodiment, the nucleic acid molecule comprises a sequence of nucleotides encoding one or more conserved GPAT amino acid sequences as provided in SEQ ID NOs:225, 226, and 227, or a sequence of amino acids which is at least 50%, preferably at least 60%, more preferably at least 65% identical thereto.

In another embodiment, the nucleic acid molecule comprises a sequence of nucleotides encoding a DGAT2. The sequence of nucleotides may comprise i) a sequence of nucleotides selected from any one of SEQ ID NO:204 to 211, ii) encode a polypeptide comprising amino acids having a sequence as provided in any one of SEQ ID NO:212 to 219, or a biologically active fragment thereof, iii) be at least 50% identical to i) or ii), or iv) hybridize to any one of i) to iii) under stringent conditions. In a preferred embodiment, the DGAT2 comprises a sequence of nucleotides of SEQ ID NO:204 and/or a sequence of nucleotides encoding a polypeptide comprising amino acids having a sequence as provided in SEQ ID NO:212.

A cell comprising a nucleic acid molecule encoding an acyltransferase operably linked to a promoter which is active in the cell may be obtained using standard procedures in the art such as by introducing the nucleic acid molecule into a cell by, for example, calcium phosphate precipitation, polyethylene glycol treatment, electroporation, and combinations of these treatments. Other methods of cell transformation can also be used and include, but are not limited to, the introduction of DNA into plants by direct DNA transfer or injection. Transformed plant cells may also be obtained using *Agrobacterium*-mediated transfer and acceleration methods as described herein.

The method further comprises determining if the level of MAG, DAG and/or TAG produced in the cell is increased when compared to a corresponding cell lacking the nucleic acid using known techniques in the art such as those exemplified in Example 1. For instance, lipids can be extracted in a chloroform/methanol solution, dried and separated by thin layer chromatography (TLC). Identities of TAG, DAG, MAG, free fatty acid, and other lipids can be verified with internal lipid standards after staining with iodine vapor. The resultant chromatograms can analyzed using a PhosphorImager and the amount of MAG, DAG and TAG quantified on the basis of the known amount of internal standards, or alternatively, the cells may be fed sn-2 monooleoylglycerol[$^{14}$C]or [$^{14}$C]glycerol-3-phosphate and associated radioactivity quantitated by liquid scintillation counting (i.e., the amount of labelled MAG, DAG and TAG is quantified).

The method further comprises identifying a nucleic acid molecule encoding a acyltransferase having an increased ability to produce MAG, DAG and/or TAG in a cell. In a preferred embodiment, the acyltransferase catalyzes an enzyme reaction in the MGAT pathway. In a further preferred embodiment, DAG is increased via the MGAT pathway (i.e., acylation of MAG with fatty acyl-CoA is catalysed by a MGAT to form DAG). In another or additional embodiment, the substrate MAG is produced by a GPAT which also has phosphatase activity and/or DAG is acylated with fatty acyl-CoA by a DGAT and/or a MGAT having DGAT activity to form TAG.

EXAMPLES

Example 1

General Materials and Methods

Expression of Genes in Plant Cells in a Transient Expression System

Genes were expressed in plant cells using a transient expression system essentially as described by Voinnet et al. (2003) and Wood et al. (2009). Binary vectors containing the coding region to be expressed by a strong constitutive e35S promoter containing a duplicated enhancer region were introduced into *Agrobacterium tumefaciens* strain AGL1. A chimeric binary vector, 35S:p19, for expression of the p19 viral silencing suppressor was separately introduced into AGL1, as described in WO2010/057246. The recombinant cells were grown to stationary phase at 28° C. in LB broth supplemented with 50 mg/L kanamycin and 50 mg/L rifampicin. The bacteria were then pelleted by centrifugation at 5000 g for 5 min at room temperature before being resuspended to OD600=1.0 in an infiltration buffer containing 10 mM MES pH 5.7, 10 mM $MgCl_2$ and 100 uM acetosyringone. The cells were then incubated at 28° C. with shaking for 3 hours after which the OD600 was measured and a volume of each culture, including 35S:p19, required to reach a final concentration of OD600=0.125 added to a fresh tube. The final volume was made up with the above buffer. Leaves were then infiltrated with the culture mixture and the plants were typically grown for a further three to five days after infiltration before leaf discs were recovered for either purified cell lysate preparation or total lipid isolation. Control infiltrations were the 35S:p19 strain only.

Purified Leaf Lysate Assay

*Nicotiana benthamiana* leaf tissues previously infiltrated as described above were ground in a solution containing 0.1 M potassium phosphate buffer (pH 7.2) and 0.33 M sucrose using a glass homogenizer. Leaf homogenate was centrifuged at 20,000 g for 45 minutes at 4° C. after which each supernatant was collected. Protein content in each supernatant was measured according to Bradford (1976) using a Wallac1420 multi-label counter and a Bio-Rad Protein Assay dye reagent (Bio-Rad Laboratories, Hercules, Calif. USA). Acyltransferase assays used 100 μg protein according to Cao et al. (2007) with some modifications. The reaction medium contained 100 mM Tris-HCl (pH 7.0), 5 mM $MgCl_2$, 1 mg/mL BSA (fatty acid-free), 200 mM sucrose, 40 mM cold oleoyl-CoA, 16.4 μM sn-2 monooleoylglycerol[t$^{14}$C](55mCi/mmol, American Radiochemicals, Saint Louis, Mo. USA) or 6.0 μM [$^{14}$C]glycerol-3-phosphate (G-3-P) disodium salt (150 mCi/mmol, American Radiochemicals). The assays were carried out for 7.5, 15, or 30 minutes.

Lipid Analysis

Analysis of Lipids from Leaf Lysate Assays

Lipids from the lysate assays were extracted using chloroform:methanol:0.1 M KCl (2:1:1) and recovered. The different lipid classes in the samples were separated on Silica gel 60 thin layer chromatography (TLC) plates (MERCK, Dermstadt, Germany) impregnated with 10% boric acid. The solvent system used to fractionate TAG from the lipid extract consisted of chloroform/acetone (90/10 v/v). Individual lipid classes were visualized by exposing the plates to iodine vapour and identified by running parallel authentic standards on the same TLC plate. The plates were exposed to phosphor imaging screens overnight and analysed by a Fujifilm FLA-5000 phosphorimager before liquid scintillation counting for DPM quantification.

Total Lipid Isolation and Fractionation

Tissues were freeze-dried, weighed and total lipids extracted as described by Bligh and Dyer (1959). The different lipid classes in each sample were separated on Silica gel 60 TLC plates. The solvent system used to fractionate neutral lipids (NL) and polar lipids (PL) consisted of hexane/diethyl ether/acetic acid (70/30/1 v/v/v). Individual lipid classes were visualized by exposing the plate to iodine vapour and identified by running parallel authentic standards on the same TLC plate.

To determine fatty acid composition in lipid samples, fatty acid methyl esters (FAMEs) of NL, including TAG, DAG and/or MAG, and PL fractions were produced by removing the corresponding bands from the TLC plates and incubating these in methanol/HCl/dichloromethane (10/1/1 v/v/v) solution for 2 hours at 80° C. together with a known amount of hexadecanoic acid as an internal standard. FAMEs were extracted in hexane/DCM, concentrated to a small volume in hexane and injected into a gas chromatograph.

The amount of individual and total fatty acids (TFA) present in the lipid fractions was quantified by determining the area under each peak and calculated by comparison with the peak area for the known amount of internal standard.

Capillary Gas-Liquid Chromatography (GC)

FAMEs were analysed by gas chromatography (GC) using an Agilent Technologies 6890N gas chromatograph (Palo Alto, Calif., USA) equipped with an Equity™-1 fused silica capillary column (15 m×0.1 mm i.d., 0.1 μm film thickness), an FID, a split/splitless injector and an Agilent Technologies 7683 Series auto sampler and injector. Helium was used as the carrier gas. Samples were injected in splitless mode at an oven temperature of 120° C. After injection, the oven temperature was raised to 270° C. at 10° $C.min^{-1}$ and finally to 310° C. at 5° $C.min^{-1}$. Peaks were quantified with Agilent Technologies ChemStation software (Rev B.03.01 (317), Palo Alto, Calif., USA).

DGAT Assay in *Saccharomyces Cerevisiae* H1246

*Saccharomyces cerevisiae* strain H1246 is completely devoid of DGAT activity and lacks TAG and sterol esters as a result of knockout mutations in four genes (DGA1, LRO1, ARE1, ARE2). The addition of free fatty acid (e.g. 1 mM 18:1$^{Δ9}$) to H1246 growth media is toxic in the absence of DGAT activity. Growth on such media can therefore be used as an indicator or selection for the presence of DGAT activity in this yeast strain.

*S cerevisiae* H1246 was transformed with the pYES2 construct (negative control), a construct encoding *Arabidopsis thaliana* DGAT1 in pYES2, or a construct encoding *Mus musculus* MGAT2 in pYES2. Transformants were fed [$^{14}$C] 18:1$^{Δ9}$ free fatty acids.

In a separate experiment, *S cerevisiae* H1246 was transformed with the pYES2 construct (negative control), a construct encoding *Bernadia pulchella* DGAT1 in pYES2, or a construct encoding *M. musculus* MGAT1 in pYES2 and fed 18:1a$^9$ free fatty acids. *S. cerevisiae* S288C wild type strain transformed with pYES2 served as a positive control.

Yeast transformants were resuspended in sterile mQ water and diluted to OD600=1. Samples were further diluted in four consecutive dilutions, each at 1/10. 2 μl of each dilution was spotted on each of the plates (YNBD, YNBG, YNBG+FA)

together with 2 µL mQ water and 2 µL of an untransformed H1246 cell suspension (OD600=1). Plates were incubated for 6 days at 30° C. before scoring growth.

Plate Medium, 40 mL Media Per Plate
- YNBD: minimal dropout medium lacking uracil and containing 2% glucose, 0.01% NP40 and 100 µL ethanol.
- YNBG: minimal dropout medium lacking uracil and containing 2% galactose, 1% raffinose, 0.01% NP40 and 100 µL ethanol.
- YNBG+FA: minimal dropout medium lacking uracil and containing 2% galactose, 1% raffinose, 0.01% NP40 and 1 mM C18:1$^{\Delta 9}$ dissolved in 100 µl ethanol.

Example 2

Constitutive Expression of a Monoacviglycerol Acyltransferase in Plant Cells

MGAT1

The enzyme activity of the monoacylglycerol acyltransferase 1 (MGAT1) encoded by the gene from *M. musculus* (Yen et al., 2002) and *A. thaliana* diacylglycerol acyltransferase (DGAT1) (Bouvier-Nave et al., 2000), used here as a comparison with MGAT1, were demonstrated in *N. benthamiana* leaf tissue using a transient expression system as described in Example 1.

A vector designated 35S-pORE04 was made by inserting a PstI fragment containing a 35S promoter into the SfoI site of vector pORE04 after T4 DNA polymerase treatment to blunt the ends (Coutu et al., 2007). A chimeric DNA encoding the *M. musculus* MGAT1, codon-optimised for *Brassica napus*, was synthesized by Geneart and designated 0954364_MGAT_pMA. A chimeric DNA designated 35S: MGAT1 and encoding the *M. musculus* MGAT1 (Genbank Accession No. Q91ZV4) for expression in plant cells was made by inserting the entire coding region of 0954364_MGAT_pMA, contained within an EcoRI fragment, into 35S-pORE04 at the EcoRI site. The vector containing the 35S:MGAT1 construct was designated as pJP3184. Similarly, a chimeric DNA 35S:DGAT1 encoding the *A. thaliana* DGAT1 (Genbank Accession No. AAF19262) for expression in plant cells was made by inserting the entire coding region of pXZP513E, contained within a BamHI-EcoRV fragment, into 35S-pORE04 at the BamHI-EcoRV site. The vector containing the 35S:DGAT1 construct was designated pJP2078.

The chimeric vectors were introduced into *A. tumefaciens* strain AGL1 and cells from cultures of these infiltrated into leaf tissue of *N. benthamiana* plants in a 24° C. growth room. In order to allow direct comparisons between samples and to reduce inter-leaf variation, samples being compared were infiltrated on either side of the same leaf. Experiments were performed in triplicate. Following infiltration, the plants were grown for a further three days before leaf discs were taken, freeze-dried, and lipids extracted from the samples were fractionated and quantified as described in Example 1. This analysis revealed that the MGAT1 and DGAT1 genes were functioning to increase leaf oil levels in *N. benthamiana* as follows.

Leaf tissue transformed with the 35S:p19 construct only (negative control) contained an average of 4 g free fatty acid (FFA) derived from DAG/mg dry leaf weight and 5 µg FFA derived from TAG/mg dry leaf weight. Leaf tissue transformed with the 35S:p19 and 35S:DGAT1 constructs (control for expression of DGAT1) contained an average of 4 µg FFA derived from DAG/mg dry leaf weight and 22 µg FFA derived from TAG/mg dry leaf weight. Leaf tissue transformed with the 35 S:p19 and 35S:MGAT1 constructs contained an average of 8 µg FFA derived from DAG/mg dry leaf weight and 44 µg FFA derived from TAG/mg dry leaf weight. Leaf tissue transformed with the 35S:p19, 35S:DGAT1 and 35S:MGAT1 constructs did not contain DAG or TAG levels higher than those observed in the 35S:p19 and 35S:MGAT1 infiltration (FIG. 2). Also, a decrease in the level of saturates in seeds was noted after MGAT expression when compared with either the p19 control or DGAT1 samples (Table 2).

The data described above demonstrated that the MGAT1 enzyme was far more active than the DGAT1 enzyme in promoting both DAG and TAG accumulation in leaf tissue. Expression of the MGAT1 gene resulted in twice as much TAG and DAG accumulation in leaf tissue compared to when the DGAT1 was expressed. This result was highly surprising and unexpected, considering that the MGAT is an enzyme expressed in mouse intestine, a vastly different biological system than plant leaves. This study was the first demonstration of ectopic MGAT expression in a plant cell.

Leaf samples infiltrated with *M. musculus* MGAT1 accumulated double the DAG and TAG relative to leaf tissue infiltrated with *A. thaliana* DGAT1 alone. The efficiency of the production of TAG was also surprising and unexpected given that the mouse MGAT has only very low activity as a DGAT. Leaf tissue infiltrated with genes encoding both MGAT1 and DGAT1 did not accumulate significantly more TAG than the MGAT1-only leaf sample. FIG. 1 is a representation of various TAG accumulation pathways, most of which converge at DAG, a central molecule in lipid synthesis. For instance, MAG, DAG and TAG can be inter-converted via various enzyme activities including transacylation, lipase, MGAT, DGAT and PDAT. A decrease in the level of saturates was also noted after MGAT expression.

MGAT2

A chimeric DNA designated 35S:MGAT2 and encoding the *M. musculus* MGAT2 for expression in plant cells was made by inserting the entire MGAT2 coding region, contained within an EcoRI fragment, into 35S-pOREO4 at the EcoRI site. The enzyme activity of the monoacylglycerol acyltransferase 2 (MGAT2) encoded by the gene from *M. musculus* (Yen, 2003) (Genbank Accession No. Q80W94) and *A. thaliana* DGAT1 (Bouvier-Nave et al., 2000), used here as a comparison with MGAT2, was also demonstrated in *N. benthamiana* leaf tissue using a transient expression system as described in Example 1.

Compared with controls, DGAT1 expression increased leaf TAG 5.9-fold, MGAT2 by 7.3-fold and the combination of MGAT2+DGAT1 by 9.8-fold (FIG. 3). The ability of MGAT2 alone to yield such significant increases in TAG was unexpected for a number of reasons. Firstly, the amount of substrate MAG present in leaf tissue is known to be low and large increases in TAG accumulation from this substrate would not be expected. Secondly, the addition of MGAT activity alone (i.e., addition of MGAT2 which does not have DGAT activity) would be expected to yield DAG, not TAG, especially in a leaf environment where little native DGAT activity is usually present.

Discussion

The present inventors have surprisingly demonstrated that the transgenic expression of a MGAT gene results in significant increases in lipid yield in plant cells. The present inventors understand that Tumaney et al. had isolated a DGAT with some MGAT activity and that they were not successful in attempts to clone a gene encoding a MGAT as defined herein. Tumaney et al. (2001) reported MGAT activity in peanut and isolated an enzyme responsible for this activity. However, Tumaney et al. did not publish results of tests for DGAT activity and it therefore seems that the enzyme reported was a DGAT with some MGAT activity. Indeed, previous work had failed to identify any MGAT activity in other species (Stobart et al., 1997). Furthermore, it was surprising that the enzyme isolated by Tumaney et al. was a soluble, cytosolic, enzyme rather than a membrane-bound enzyme. Finally, although Tumaney et al. later published abstracts claiming that they had isolated MGAT genes from peanut (Rajasekharan et al., 2006) and *Arabidopsis* (Ghosh et al., 2006), no papers were ever published describing the isolation of these genes.

Example 3

Biochemical Demonstration of Transgenic MGAT Activity in Leaf Extracts

Cell lysates were made from *N. benthamiana* leaf tissue that had been infiltrated with 35S:MGAT1, 35S:MGAT2 and 35S:DGAT1, as described in Example 1. Separate leaf infiltrations were performed, each in triplicate, for strains containing the 35S:p19 construct only (negative control), the 35S:MGAT2 strain together with the 35S:p19 strain, and a mixture of the 35S:MGAT2 and 35S:DGAT1 *Agrobacterium* strains with the 35S:p19 strain. The triplicate samples were harvested after three days and a purified cell lysate prepared by mechanical tissue lysis and centrifugation. The MGAT activities of the purified cell lysates were compared by feeding [$^{14}$C]MAG to the lysates as described in Example 1. The data are shown in FIG. 4.

Little MGAT activity was observed in the 35S:p19 control sample, since most of the radioactivity remained in MAG throughout the assay. In contrast, the majority of the labelled MAG in the 35S:MGAT2 sample was rapidly converted to DAG (FIG. 4, central panel), indicating strong MGAT activity expressed from the 35S:MGAT2 construct. Furthermore, a significant amount of TAG was also produced. The TAG production observed in the 35S:MGAT2 sample was likely due to native *N. benthamiana* DGAT activity, or produced by another TAG synthesis route. The amount of TAG production was greatly increased by the further addition of 35S:DGAT1 (FIG. 4, right hand panel), indicating that the MGAT2 enzyme produced DAG which was accessible for conversion to TAG by DGAT1 in plant vegetative tissues.

Example 4

Biochemical Demonstration of the Production of MGAT-Accessible MAG in Leaf Extracts In the in vitro assays described in Example 3 using leaf lysates, the substrates (sn-2 MAG and oleoyl-CoA) were exogenously supplied, whereas in vivo MGAT activity in intact plant tissues would require the native presence of these substrates. The presence of low levels of MAG is various plant tissues has been reported previously (Hirayama and Hujii, 1965; Panekina et al., 1978; Lakshminarayana et al., 1984; Perry & Harwood, 1993). To test whether the MGAT2 could access MAG produced by native plant pathways, the above experiment was repeated but this time feeding [$^{14}$C]G-3-P to the lysates. The resultant data are shown schematically in FIG. 5.

The production of labelled MAG was observed in all samples, indicating the de novo production of MAG from the G-3-P in plant leaf lysates. Labelled DAG and TAG products were also observed in all samples although these were relatively low in the 35S:p19 control sample, indicating that the production of these neutral lipids by the endogenous Kennedy pathway was relatively low in this sample. In contrast, the majority of the label in the MGAT2 and MGAT2+DGAT1 samples appeared in the DAG and TAG pools, indicating that the exogenously added MGAT catalysed conversion of the MAG that had been produced from the labelled G-3-P by a native plant pathway.

Examples 2 to 4 demonstrate several key points: 1) Leaf tissue can synthesise MAG from G-3-P such that the MAG is accessible to an exogenous MGAT expressed in the leaf tissue; 2) Even an MGAT which is derived from mammalian intestine can function in plant tissues, not known to possess an endogenous MGAT, requiring a successful interaction with other plant factors involved in lipid synthesis; 3) DAG produced by the exogenous MGAT activity is accessible to a plant DGAT, or an exogenous DGAT, to produce TAG; and 4) the expression of an exogenous MGAT can yield greatly increased TAG levels in plant tissues, levels which are at least as great as that yielded by exogenous *A. thaliana* DGAT1 expression.

Example 5

Expression of DGAT1, MGAT1 and MGAT2 in Yeast

Chimeric yeast expression vectors were constructed by inserting genes encoding the *A. thaliana* DGAT1, *M. musculus* MGAT1 and *M. musculus* MGAT2 into the pYES2 vector to yield pYES2:DGAT1, pYES2:MGAT1 and pYES2:MGAT2. These constructs were transformed in *Saccharomyces cerevisiae* strain H1246 which is completely devoid of DGAT activity and lacks TAG and sterol esters as a result of knockout mutations in four genes (DGA1, LRO1, ARE1, ARE2). Yeast strain H1246 is capable of synthesizing DAG from exogenously added fatty acids, but is unable to convert the DAG to TAG because of the knockout mutations. The transformed yeast cultures were fed [$^{14}$C]18:1$^{\Delta 9}$ before total lipids were extracted and fractionated by TLC as described in Example 1. An autoradiogram of a representative TLC plate is shown in FIG. 6.

TAG formation, indicating the presence of DGAT activity, was observed for the yeast cells containing either DGAT1 (positive control) and the mammalian MGAT1, but not in cells containing the MGAT2. It was concluded that MGAT1 from mouse also had DGAT activity in yeast cells, and therefore functioned as a dual function MGAT/DGAT enzyme, whereas MGAT2 did not have detectable DGAT activity and was therefore solely an MGAT.

Example 6

Expression of a Monoacylglycerol Acyltransferase in Plants, Seeds and Fungi

Expression of MGAT1 in *Arabidopsis Thaliana* Seeds

A gene encoding *M. musculus* MGAT1 and under the control of a seed-specific promoter (FP1, a truncated *Brassica napus* napin promoter) was used to generate stably transformed *A. thaliana* plants and progeny seeds. The vector designated pJP3174 was made by inserting a SaiI fragment containing an EcoRI site flanked by the FP1 promoter and *Glycine max* lectin polyadenylation signal into the SalI-XhoI site of vector pCW141. The pCW141 vector also contained an FP1-driven, intron-interrupted, seed-secreted GFP as a screenable marker gene. The chimeric gene designated FP1:MGAT1-GFP was made by inserting the entire coding region of the construct 0954364_MGAT_pMA, contained within an EcoRI fragment, into pJP3174 at the EcoRI site, generating pJP3179. This chimeric vector was introduced into *A. tumefaciens* strain AGL1 and cells from culture of the transformed *Agrobacterium* used to treat *A. thaliana* (ecotype Columbia) plants using the floral dip method for transformation (Clough and Bent, 1998). After maturation, the seeds from the treated plants were viewed under a Leica MZFLIII dissection microscope and ebq 100 mercury lamp. Fifteen transgenic seeds (strongly GFP positive) and fifteen non-transgenic (GFP negative) seeds were isolated and each set pooled. The GFP positive and GFP negative pools were analysed for total fatty acid content as described in Example 1. This analysis provided the average fatty acid content and composition for seeds transformed with the MGAT construct, but in a population which may have contained both hemizygous and homozygous transformed seeds.

This analysis revealed that the MGAT1 gene was functioning to increase seed oil levels in *A. thaliana* seed with the fifteen non-transgenic seeds (control, the same as wild-type) containing an average of 69.4 μg total fatty acids while the fifteen transgenic seeds transformed with the GFP gene, and therefore likely to contain the FP1:MGAT1 genetic construct, contained an average of 71.9 μg total fatty acids. This was an increase of 3.5% in the oil content relative to the control (wild-type). The analysis also revealed that the MGAT gene was functioning to enrich polyunsaturated fatty acids in the seed, as seen from the fatty acid composition of the total extracted lipid obtained from the seeds. In particular, the amount of ALA present as a percentage of the total fatty acid extracted from the seeds increasing from 16.0 to 19.6%. Similarly, the percentage of the fatty acid 20:2n6 increased from 1.25% to 1.90% and the fatty acid 20:3n3 increased from 0.26% to 0.51% (Table 2).

TABLE 2

Effect of MGAT expression on seed fatty acid composition.
FA profile (% of TFA)

| Sample | 16:00 | 16:01 | 16:3w3 | C18:0 | C18:1d9 | C18:1d11 | C18:2 | C18:3 |
|---|---|---|---|---|---|---|---|---|
| Control | 7.41 | 0.36 | 0.12 | 3.00 | 15.26 | 1.98 | 30.93 | 15.98 |
| MGAT1 | 7.11 | 0.32 | 0.11 | 2.95 | 13.86 | 1.51 | 28.87 | 19.59 |

| Sample | C20:0 | 20:1d11 | 20:1iso | 20:2n6 | 20:3n3 | C22:0 | C22:1 | C24:0 | 24:1d15 | Total |
|---|---|---|---|---|---|---|---|---|---|---|
| Control | 1.86 | 17.95 | 1.74 | 1.25 | 0.26 | 0.57 | 0.98 | 0.20 | 0.17 | 100.00 |
| MGAT1 | 1.90 | 17.22 | 1.71 | 1.90 | 0.51 | 0.57 | 1.52 | 0.19 | 0.17 | 100.00 |

A further experiment was performed where the FP1:MGAT1-GFP chimeric DNA was modified to remove the GFP gene. This genetic construct, designated FP1:MGAT1, was transformed into an *A. thaliana* line which was mutant for FAD2. The total fatty acid content of the $T_2$ seed from antibiotic resistant $T_1$ plants, as well as parental lines grown alongside these plants, was determined according to Example 1. The data is shown in Table 3. The average total fatty acids of the seed from the control lines was 347.9 μg/100 seeds whereas the average of the transgenic seeds was 381.0 μg/100 seeds. When the data for the control line C6 was excluded for determining the average, the average for the controls was 370 μg/100 seeds. The oil content in the transgenic seeds represented an increase of about 3% in relative terms compared to the oil content in the untransformed seeds.

The coding region of the mouse MGAT2 gene, codon optimised for expression in plant cells, is substituted for the MGAT1 in the constructs mentioned above, and introduced into *Arabidopsis*. Seeds from the resultant transgenic plants are increased for oil content.

TABLE 3

*Arabidopsis thaliana* $T_2$ FP1:MGAT1 transgenic and parental control seed fatty acid profiles and total fatty acid quantification.

| Sample | C16:0 | C16:1 | C18:0 | C18:1 | C18:1d11 | C18:2 | C18:3 | C20:0 | 20:1d11 | C22:0 | C24:0 | 24:1d15 | μg FA/100 seeds |
|---|---|---|---|---|---|---|---|---|---|---|---|---|---|
| C7 | 6.2 | 0.5 | 2.5 | 81.3 | 4.2 | 0.6 | 2.7 | 0.7 | 0.7 | 0.3 | 0.2 | 0.1 | 442.5 |
| C4 | 6.3 | 0.4 | 2.4 | 81.7 | 3.9 | 0.5 | 2.5 | 0.9 | 0.6 | 0.4 | 0.2 | 0.1 | 403.8 |
| C8 | 6.4 | 0.5 | 2.6 | 81.1 | 4.1 | 0.6 | 2.6 | 0.8 | 0.6 | 0.4 | 0.2 | 0.1 | 403.2 |
| C2 | 6.2 | 0.5 | 2.4 | 81.4 | 4.1 | 0.6 | 2.7 | 0.8 | 0.6 | 0.4 | 0.2 | 0.1 | 377.0 |
| C1 | 6.4 | 0.5 | 2.4 | 80.6 | 4.1 | 0.7 | 3.3 | 0.8 | 0.6 | 0.4 | 0.2 | 0.1 | 344.8 |
| C3 | 6.4 | 0.5 | 2.6 | 80.0 | 4.1 | 0.6 | 3.5 | 0.8 | 0.6 | 0.4 | 0.2 | 0.2 | 314.3 |
| C5 | 6.3 | 0.5 | 2.6 | 80.7 | 4.4 | 0.6 | 2.4 | 0.7 | 0.6 | 0.9 | 0.2 | 0.1 | 310.6 |
| C6 | 6.7 | 0.7 | 2.7 | 77.2 | 5.0 | 0.8 | 4.3 | 0.9 | 0.7 | 0.4 | 0.3 | 0.2 | 186.8 |
| M23 | 5.9 | 0.4 | 2.0 | 81.4 | 5.0 | 0.8 | 2.4 | 0.7 | 0.7 | 0.5 | 0.2 | 0.2 | 455.7 |
| M10 | 6.0 | 0.4 | 2.4 | 82.3 | 4.2 | 0.7 | 2.2 | 0.7 | 0.6 | 0.3 | 0.2 | 0.1 | 437.7 |
| M22 | 5.9 | 0.4 | 2.2 | 81.4 | 4.8 | 0.8 | 2.4 | 0.7 | 0.6 | 0.4 | 0.2 | 0.2 | 425.0 |
| M25 | 6.0 | 0.4 | 2.2 | 81.7 | 4.6 | 0.7 | 2.4 | 0.8 | 0.6 | 0.3 | 0.2 | 0.1 | 406.7 |
| M8 | 6.0 | 0.4 | 2.2 | 81.6 | 4.5 | 0.8 | 2.5 | 0.7 | 0.6 | 0.3 | 0.2 | 0.2 | 404.5 |
| M14 | 5.7 | 0.4 | 2.1 | 81.8 | 4.6 | 0.8 | 2.5 | 0.7 | 0.6 | 0.3 | 0.2 | 0.2 | 396.4 |
| M26 | 6.2 | 0.4 | 2.2 | 81.8 | 4.4 | 0.8 | 2.2 | 0.7 | 0.6 | 0.4 | 0.2 | 0.1 | 393.0 |
| M6 | 5.9 | 0.4 | 2.2 | 81.8 | 4.5 | 0.8 | 2.4 | 0.7 | 0.6 | 0.3 | 0.2 | 0.2 | 392.9 |
| M5 | 5.9 | 0.5 | 2.2 | 80.9 | 4.8 | 0.9 | 2.6 | 0.7 | 0.7 | 0.5 | 0.2 | 0.2 | 389.7 |
| M17 | 6.3 | 0.4 | 2.3 | 75.1 | 4.7 | 4.8 | 4.4 | 0.7 | 0.6 | 0.3 | 0.2 | 0.1 | 388.4 |
| M9 | 6.1 | 0.4 | 2.3 | 81.8 | 4.4 | 0.7 | 2.4 | 0.7 | 0.6 | 0.3 | 0.2 | 0.1 | 388.2 |

TABLE 3-continued

Arabidopsis thaliana T₂ FP1:MGAT1 transgenic and
parental control seed fatty acid profiles and total fatty acid quantification.

| Sample | C16:0 | C16:1 | C18:0 | C18:1 | C18:1d11 | C18:2 | C18:3 | C20:0 | 20:1d11 | C22:0 | C24:0 | 24:1d15 | µg FA/100 seeds |
|---|---|---|---|---|---|---|---|---|---|---|---|---|---|
| M20 | 6.2 | 0.4 | 2.2 | 81.5 | 4.7 | 0.7 | 2.3 | 0.7 | 0.6 | 0.3 | 0.2 | 0.1 | 379.1 |
| M12 | 6.2 | 0.4 | 2.2 | 81.6 | 4.4 | 1.0 | 2.2 | 0.7 | 0.6 | 0.3 | 0.2 | 0.1 | 374.7 |
| M18 | 6.2 | 0.4 | 2.4 | 81.3 | 4.7 | 0.7 | 2.3 | 0.8 | 0.5 | 0.3 | 0.2 | 0.1 | 369.1 |
| M24 | 6.1 | 0.4 | 2.2 | 81.6 | 4.6 | 0.7 | 2.3 | 0.9 | 0.6 | 0.3 | 0.2 | 0.1 | 361.7 |
| M7 | 5.9 | 0.4 | 2.3 | 81.9 | 4.5 | 0.7 | 2.3 | 0.7 | 0.6 | 0.3 | 0.2 | 0.1 | 359.4 |
| M4 | 6.2 | 0.4 | 2.4 | 81.3 | 4.4 | 0.7 | 2.5 | 0.8 | 0.5 | 0.3 | 0.2 | 0.2 | 352.3 |
| M13 | 6.1 | 0.4 | 2.3 | 81.4 | 4.5 | 0.8 | 2.4 | 0.7 | 0.6 | 0.3 | 0.2 | 0.1 | 352.0 |
| M16 | 6.1 | 0.4 | 2.2 | 81.8 | 4.4 | 0.7 | 2.4 | 0.7 | 0.6 | 0.3 | 0.2 | 0.2 | 340.5 |
| M19 | 6.1 | 0.4 | 2.3 | 80.9 | 4.9 | 0.8 | 2.7 | 0.7 | 0.5 | 0.3 | 0.2 | 0.1 | 318.6 |
| M3 | 6.0 | 0.5 | 2.3 | 81.1 | 4.7 | 0.9 | 2.7 | 0.7 | 0.6 | 0.3 | 0.2 | 0.2 | 316.6 |

Expression of MGAT1 in *Brassica Napus* Seeds

The vector FP1:MGAT1 used for the expression of *M. musculus* MGAT1 in *Arabidopsis thaliana* seeds was used to generate transformed *B. napus* plants. The vector was introduced into *A. tumefaciens* strain AGL1 via standard electroporation procedures. Cultures were grown overnight at 28° C. in LB medium with agitation at 150 rpm. The bacterial cells were collected by centrifugation at 4000 rpm for 5 minutes, washed with Winans' AB (Winans, 1988) and re-suspended in 10 mL of Winans' AB medium (pH 5.2) and grown with kanamycin (50 mg/L) and rifampicin (25 mg/L) overnight with the addition of 100 µM acetosyringone. Two hours before infection of the *Brassica* cells, spermidine (120 mg/L) was added and the final density of the bacteria adjusted to an OD 600 nm of 0.3-0.4 with fresh AB media. Freshly isolated cotyledonary petioles from 8-day old *B. napus* seedlings grown on 1/2 MS (Murashige-Skoog, 1962) or hypocotyl segments preconditioned by 3-4 days on MS media with 1 mg/L thidiazuron (TDZ)+0.1 mg/L alpha-naphthaleneacetic acid (NAA) were infected with 10 mL *Agrobacterium* cultures for 5 minutes. Explants (cotyledonary petiole and hypocotyl) infected with *Agrobacterium* were then blotted on sterile filter paper to remove the excess *Agrobacterium* and transferred to co-cultivation media (MS media with 1 mg/L TDZ+0.1 mg/L NAA+100 µM acetosyringone) supplemented with or without different antioxidants (L-cysteine 50 mg/L and ascorbic 15 mg/L). All the plates were sealed with parafilm and incubated in the dark at 23-24° C. for 48 hours.

The co-cultivated explants (cotyledonary petiole and hypocotyl) were then washed with sterile distilled water+500 mg/L cefotaxime+50 mg/L timentin for 10 minutes, rinsed in sterile distilled water for 10 minutes, blotted dry on sterile filter paper, transferred to pre-selection media (MS+1 mg/L TDZ+0.1 mg/L NAA+20 mg/L adenine sulphate (ADS)+1.5 mg/L AgNO₃+250 mg/L cefotaxime and 50 mg/L timentin) and cultured for five days at 24° C. with a 16 hour/8 hour photoperiod. They were then transferred to selection media (MS+1 mg/L TDZ+0.1 mg/L NAA+mg/L ADS+1.5 mg/L AgNO₃+250 mg/L cefotaxime and 50 mg/L timentin) with 1.5 mg/L glufosinate ammonium and cultured for 4 weeks at 24° C. with 16 hour/8 hour photoperiod with a biweekly subculture onto the same media. Explants with green callus were transferred to shoot initiation media (MS+1 mg/L kinetin+20 mg/L ADS+1.5 mg/L AgNO₃+250 mg/L cefotaxime+50 mg/L timentin+1.5 mg/L glufosinate ammonium) and cultured for another 2-3 weeks. Shoots emerging form the resistant explants were transferred to shoot elongation media (MS media with 0.1 mg/L gibberelic acid+20 mg/L ADS+1.5 mg/L AgNO₃+250 mg/L ceftoxime+1.5 mg/L glufosinate ammonium and cultured for another two weeks. Healthy shoots 2-3 cm long were selected and transferred to rooting media (1/2 MS with 1 mg/L NAA+20 mg/L ADS+1.5 mg/L AgNO₃+250 mg/L cefotaxime) and cultured for 2-3 weeks. Well established shoots with roots were transferred to pots (seedling raising mix) and grown in a growth cabinet for two weeks and subsequently transferred to glasshouse. Sixteen individual transformants were confirmed to be transgenic for the FP1:MGAT1 construct and grew normally under glasshouse conditions. Plant growth appeared normal and the plants were fertile, flowering and setting seed normally. The plants are grown to maturity and seeds obtained from transformed plants are harvested and analysed for seed oil content and fatty acid composition. The seed-specific expression of MGAT1 increases oil content and increases the percentage of polyunsaturated fatty acids in the *Brassica* seedoil.

The coding region of the mouse MGAT2 gene, codon optimised for expression in plant cells, is substituted for the MGAT1 in the constructs mentioned above, and introduced into *Brassica*. Seeds from the resultant transgenic plants are increased for oil content.

Expression of MGAT1 in *Gossypium Hirsutum* Seeds

The same seed-specific chimeric gene used for the expression of *M. musculus* MGAT1 in *Arabidopsis thaliana* seeds was used to generate transformed *Gossypium hirsutum* plants. The vector designated FP1:MGAT1 was introduced into *A. tumefaciens* strain AGL1 via standard electroporation procedures and cells from the *Agrobacterium* culture used to introduce the chimeric DNAs into cells of *Gossypium hirsutum*, variety Coker315. Cotyledons excised from 10-day old cotton seedlings were used as explants and infected and co-cultivated with *A. tumefaciens* for a period of two days. This was followed by a six-week selection on MS medium (Murashige and Skoog, 1962) containing 0.1 mg/L 2,4-D, 0.1 mg/L kinetin, 50 mg/L kanamycin sulphate, and 25 mg/L cefotaxime. Healthy calli derived from the cotyledon explants were transferred to MS medium containing 5 mg/L 6-(γ,γ-dimethylallylamino)-purine (2ip), 0.1 mg/L naphthalene acetic acid (NAA), 25 mg/L kanamycin, and 250 mg/L cefotaxime for a second period of six weeks at 28° C. Somatic embryos that formed after about six to ten weeks of incubation were germinated and maintained on the same medium, but without added phytohormone or antibiotics. Plantlets developed from the somatic embryos were transferred to soil and maintained in a glasshouse once leaves and roots were developed, with 28° C./20° C. (day/night) growth temperature. Transgenic plants containing the FP1-MGAT1 construct were grown in the glasshouse, flowered and produced bolls containing seeds. The seeds are harvested on maturity. The seed-specific expression of MGAT1 increases oil content and increases the percentage of polyunsaturated fatty acids in the cotton seedoil.

Expression of a MGAT1 and MGAT2 Genes in *N. Benthamiana* Plants After Stable Transformation

*N. benthamiana* was stably transformed with the 35S: MGAT1 construct described in Example 2. 35S:MGAT1 was introduced into *A. tumefaciens* strain AGL1 via standard electroporation procedure. The transformed cells were grown on solid LB media supplemented with kanamycin (50 mg/L) and rifampicin (25 mg/L) and incubated at 28° C. for two days. A single colony was used to initiate fresh culture. Following 48 hours vigorous culture, the cells were collected by centrifugation at 2,000×g and the supernatant was removed. The cells were resuspended in fresh solution containing 50% LB and 50% MS medium at the density of $OD_{600}$=0.5.

Leaf samples of *N. benthamiana* grown in vitro were excised and cut into square sections around 0.5-1 cm² in size with a sharp scalpel while immersed in the *A. tumefaciens* solution. The wounded *N. benthamiana* leaf pieces submerged in *A. tumefaciens* were allowed to stand at room temperature for 10 minutes prior to being blotted dry on a sterile filter paper and transferred onto MS plates without supplement. Following a co-cultivation period of two days at 24° C., the explants were washed three times with sterile, liquid MS medium, then blotted dry with sterile filter paper and placed on the selective MS agar supplemented with 1.0 mg/L benzylaminopurine (BAP), 0.25 mg/L indoleacetic acid (IAA), 50 mg/L kanamycin and 250 mg/L cefotaxime. The plates were incubated at 24° C. for two weeks to allow for shoot development from the transformed *N. benthamiana* leaf pieces.

To establish rooted transgenic plants in vitro, healthy green shoots were cut off and transferred into 200 mL tissue culture pots containing MS agar medium supplemented with 25 µg/L IAA, 50 mg/L kanamycin and 250 mg/L cefotaxime. Sufficiently large leaf discs were taken from transgenic shoots and freeze-dried for TAG fractionation and quantification analysis as described in Example 1 (Table 4). The best 35S:MGAT1 *N. benthamiana* plant had a TAG content of 204.85 µg/100 mg dry weight leaf tissue compared with an average TAG content of 85.02 µg/100 mg dry weight leaf tissue in the control lines, representing an increase in TAG content of 241%.

*N. benthamiana* was also stably transformed with the 35S: MGAT2 construct described in Example 2 and a control binary vector pORE4 (Table 5). The best 35S:MGAT2 *N. benthamiana* plant had a TAG content of 79.0 µg/100 mg dry weight leaf tissue compared with a TAG content of 9.5 µg/100 mg dry weight leaf tissue in the control line, representing an increase in TAG content of 731%. The fatty acid profile of the TAG fractions was also altered with significantly reduced levels of the saturated fatty acids 16:0 and 18:0, and increased levels of the polyunsaturated fatty acids, particularly 18:3ω3 (ALA) (Table 5). The fatty acid profile of the polar lipids from the same leaf samples were not significantly affected, indicating that the changes in the fatty acid composition of the non-polar lipids was real. The control plants in this experiment were smaller and different physiologically than in the previous experiment with the 35S:MGAT1 construct, and this may have explained the different oil contents of the control plants from one experiment to the other. Experiments to directly compare the 35S:MGAT1 and 35:MGAT2 constructs with control plants are performed using plants of the same size and physiology.

A new set of constitutive binary expression vectors was made using a 35S promoter with duplicated enhancer region (e35S). 35S:MGAT1#2 (pJP3346), 35S:MGAT2#2 (pJP3347) and 35S:DGAT1#2 (pJP3352) were made by first cloning the e35S promoter, contained within a BamHI-EcoRI fragment, into pORE04 at the BamHI-EcoRI sites to yield pJP3343. pJP3346 and pJP3347 were then produced by cloning the MGAT1 and MGAT2 genes, respectively, into the EcoRI site of pJP3343. pJP3352 was produced by cloning the *A. thaliana* DGAT1, contained within a XhoI-AsiSI site, into the XhoI-AsiSI sites of pJP3343.

pJP3346, pJP3347 and pJP3352 in *Agrobacterium* strain AGL1 were used to transform *N. benthamiana* as described above. Fourteen confirmed transgenic plants were recovered for pJP3346 and 22 for pJP3347. A number of kanamycin resistant, transformed shoots have been generated with pJP3352. Expression analysis of the transgenes was performed on the plants transformed with MGAT1 or MGAT2. Plants with high levels of expression were selected. Expression analysis on plants transformed with the *A. thaliana* DGAT1 is performed. The plants grow normally and are grown to maturity. Seed is harvested when mature. Seed from high-expressing progeny are sown directly onto soil for lipid analysis of the T2 segregating population, which includes both homozygous and heterozygous plants. Oil content of leaves of plants expressing high levels of either MGAT1 or MGAT2 is significantly increased compared to plants transformed with *A. thaliana* DGAT1 or control plants.

pJP3346, pJP3347 and a control vector in AGL1 were also used to transform *A. thaliana* as described above. Twenty-five confirmed transgenic T2 plants comprising the T-DNA from pJP3346 and 43 transgenic plants for pJP3347 were identified. Expression analysis is performed on the transgenic plants. Seeds from high-expressing progeny are harvested and sown directly onto soil. Lipid analysis including oil content of the leaves from T2 and T3 progeny is performed, including from segregants lacking the transgenes. The highest levels of TAG are obtained in plants that are homozygous for the MGAT transgenes.

TABLE 4

Fatty acid profile and quantification of TAG in *Nicotiana benthamiana* leaf tissue stably transformed with the 35S:MGAT1 construct. 'M' samples are 35S:MGAT1 whilst 'C' samples are parental control plants.

| Sample | C16:0 | 16:3w3 | C18:0 | C18:1 | C18:1d11 | C18:2 | C18:3 | C20:0 | 20:3n3 | C22:0 | C24:0 | µg/100 mg DW |
|---|---|---|---|---|---|---|---|---|---|---|---|---|
| M1 | 38.7 | 0.7 | 5.1 | 8.5 | 0.4 | 7.0 | 34.4 | 1.1 | 0.3 | 0.2 | 0.4 | 204.85 |
| M8 | 33.2 | 0.8 | 4.4 | 8.1 | 0.3 | 6.5 | 42.8 | 0.9 | 0.2 | 0.2 | 0.2 | 184.20 |
| M3 | 41.1 | 0.6 | 5.3 | 10.4 | 0.4 | 5.5 | 31.8 | 1.0 | 0.4 | 0.2 | 0.2 | 133.62 |
| M2 | 42.5 | 0.5 | 5.2 | 7.4 | 0.0 | 4.8 | 34.4 | 1.0 | 0.2 | 0.3 | 0.2 | 133.57 |
| M7 | 35.2 | 0.6 | 4.5 | 8.6 | 0.0 | 4.9 | 41.7 | 1.1 | 0.3 | 0.3 | 0.2 | 128.49 |
| M5 | 49.1 | 0.6 | 6.4 | 9.0 | 0.4 | 3.7 | 16.9 | 1.1 | 0.0 | 0.5 | 0.7 | 107.39 |
| M4 | 41.9 | 0.4 | 6.0 | 9.6 | 0.0 | 4.2 | 33.0 | 1.1 | 0.2 | 0.4 | 0.2 | 93.71 |
| M6 | 41.4 | 0.4 | 5.8 | 8.2 | 0.0 | 4.3 | 34.6 | 1.1 | 0.2 | 0.3 | 0.2 | 88.38 |

TABLE 4-continued

Fatty acid profile and quantification of TAG in *Nicotiana benthamiana* leaf tissue stably transformed with the 35S:MGAT1 construct. 'M' samples are 35S:MGAT1 whilst 'C' samples are parental control plants.

| Sample | C16:0 | 16:3w3 | C18:0 | C18:1 | C18:1d11 | C18:2 | C18:3 | C20:0 | 20:3n3 | C22:0 | C24:0 | µg/100 mg DW |
|---|---|---|---|---|---|---|---|---|---|---|---|---|
| C1 | 40.2 | 0.4 | 6.1 | 8.3 | 0.0 | 7.8 | 31.9 | 1.3 | 0.2 | 0.4 | 0.3 | 81.53 |
| C2 | 39.9 | 0.6 | 5.5 | 7.1 | 0.0 | 6.9 | 35.4 | 1.1 | 0.3 | 0.4 | 0.3 | 88.52 |

TABLE 5

Fatty acid profile and quantification of TAG in *Nicotiana benthamiana* leaf tissue stably transformed with the 35S:MGAT2 construct. 'M' samples are 35S:MGAT2 whilst 'C' samples are parental control plants. Two leaves from each plant were taken and analysed separately.

| Sample | | C16:0 | 16:1d7 | 16:1d13t | C16:1 | 16:3n3 | C18:0 | C18:1 | C18:1d11 | C18:2 | C18:3n | C20:0 | µg/100 mg DW |
|---|---|---|---|---|---|---|---|---|---|---|---|---|---|
| C, leaf 1 | TAG | 34.0 | 2.7 | 0.8 | 0.0 | 0.0 | 17.3 | 6.6 | 0.0 | 15.9 | 18.7 | 0.0 | 12.9 |
| C, leaf 2 | TAG | 35.0 | 1.8 | 0.0 | 0.0 | 1.3 | 25.0 | 3.0 | 0.0 | 13.0 | 17.6 | 1.4 | 6.1 |
| M, leaf 1 | TAG | 14.6 | 0.4 | 1.0 | 0.4 | 7.7 | 5.9 | 4.0 | 0.4 | 16.8 | 47.0 | 0.6 | 97.1 |
| M, leaf 2 | TAG | 18.1 | 0.3 | 1.0 | 0.0 | 6.0 | 8.1 | 2.8 | 0.3 | 14.0 | 46.9 | 1.0 | 60.9 |
| C, leaf 1 | PL | 13.4 | 0.0 | 3.0 | 0.2 | 7.4 | 2.0 | 2.5 | 0.4 | 8.4 | 61.4 | 0.3 | 2439.3 |
| C, leaf 2 | PL | 10.3 | 0.0 | 2.4 | 0.2 | 9.7 | 1.4 | 2.0 | 0.3 | 9.5 | 63.3 | 0.0 | 4811.5 |
| M, leaf 1 | PL | 11.6 | 0.0 | 2.4 | 0.2 | 8.7 | 1.9 | 2.4 | 0.3 | 8.7 | 63.0 | 0.0 | 3568.8 |
| M, leaf 2 | PL | 10.7 | 0.0 | 2.4 | 0.2 | 9.5 | 1.6 | 1.9 | 0.3 | 9.2 | 63.3 | 0.0 | 3571.2 |

Expression of MGAT1 in Stably Transformed *Trifolium Repens* Plants

A chimeric gene encoding *M. musculus* MGAT1 was used to transform *Trifolium repens*, another dicotyledonous plant. Vectors containing the chimeric genes 35S:MGAT1 and 35S:DGAT1 were introduced into *A. tumefaciens* via a standard electroporation procedure. Both vectors also contain a 35S:BAR selectable marker gene. The transformed *Agrobacterium* cells were grown on solid LB media supplemented with kanamycin (50 mg/L) and rifampicin (25 mg/L) and incubated at 28° C. for two days. A single colony was used to initiate a fresh culture for each construct. Following 48 hours vigorous culture, the *Agrobacterium* cultures were used to treat *T. repens* (cv. Haifa) cotyledons that had been dissected from imbibed seed as described by Larkin et al. (1996). Following co-cultivation for three days the explants were exposed to 5 mg/L PPT to select transformed shoots and then transferred to rooting medium to form roots, before transfer to soil. A transformed plant containing MGAT1 was obtained. The 35S promoter is expressed constitutively in cells of the transformed plants. The oil content is increased in at least the vegetative tissues such as leaves.

Expression of MGAT in Stably Transformed *Hordeum Vulgare*

A chimeric vector including *M. musculus* MGAT1 was used to produce stably transformed *Hordeum vulgare*, a monocotyledonous plant. Vectors containing the chimeric genes Ubi:MGAT1 and Ubi:DGAT1 were constructed by cloning the entire *M. musculus* MGAT1 and *A. thaliana* DGAT1 coding regions separately into pWVEC8-Ubi. Vectors containing the chimeric genes Ubi:MGAT1 and Ubi:DGAT1 were introduced into *A. tumefaciens* strain AGL1 via a standard electroporation procedure. Transformed *Agrobacterium* cells were grown on solid LB media supplemented with kanamycin (50 mg/L) and rifampicin (25 mg/L) and the plates incubated at 28° C. for two days. A single colony of each was used to initiate fresh cultures.

Following 48 hours vigorous culture, the *Agrobacterium* cultures were used to transform cells in immature embryos of barley (cv. Golden Promise) according to published methods (Tingay et al., 1997; Bartlett et al., 2008) with some modifications. Briefly, embryos between 1.5 and 2.5 mm in length were isolated from immature caryopses and the embryonic axes removed. The resulting explants were co-cultivated for 2-3 days with the transgenic *Agrobacterium* and then cultured in the dark for 4-6 weeks on media containing timentin and hygromycin to generate embryogenic callus before being moved to transition media in low light conditions for two weeks. Callus was then transferred to regeneration media to allow for the regeneration of shoots and roots before transfer to soil. Transformed plants were obtained and transferred to the greenhouse. The MGAT1 coding region is expressed constitutively under the control of the Ubi promoter in cells of the transformed plants. Oil content is increased in at least the vegetative tissues.

The coding region of the mouse MGAT2 gene, codon optimised for expression in plant cells, is substituted for the MGAT1 in the constructs mentioned above, and introduced into *Hordeum* as described above. Vegetative tissues from the resultant transgenic plants are increased for oil content.

Expression of MGAT in Yeast Cells

A chimeric vector including *M. musculus* MGAT1 was used to transform yeast, in this example *Saccharomyces cerevisiae*, a fungal microbe suitable for production of oil by fermentation. A genetic construct Gal1:MGAT1 was made by inserting the entire coding region of a construct designated 0954364 MGAT_pMA, contained within an EcoRI fragment, into pYES2 at the EcoRI site, generating pJP3301. Similarly, a genetic construct Gal1:DGAT1, used here as a comparison and separately encoding the enzyme *A. thaliana* DGAT1 was made by inserting the entire *A. thaliana* DGAT1 coding region into pYES2. These chimeric vectors were introduced into *S. cerevisiae* strain S288C by heat shock and transformants were selected on yeast minimal medium (YMM) plates containing 2% raffinose as the sole carbon source. Clonal inoculum cultures were established in liquid YMM with 2% raffinose as the sole carbon source. Experimental cultures were inoculated from these in YMM medium containing 1%

NP-40, to an initial OD600 of about 0.3. Cultures were grown at 28° C. with shaking (about 100 rpm) until OD600 was approximately 1.0. At this point, galactose was added to a final concentration of 2% (w/v). Cultures were incubated at 25° C. with shaking for a further 48 hours prior to harvesting by centrifugation. Cell pellets were washed with water before being freeze-dried for lipid class fractionation and quantification analysis as described in Example 1. The Gal promoter is expressed inducibly in the transformed yeast cells, increasing the oil content in the cells.

The coding region of the mouse MGAT2 gene, codon optimised for expression in yeast cells, is substituted for the MGAT1 in the constructs mentioned above, and introduced into yeast. The resultant transgenic cells are increased for oil content. The genes are also introduced into the oleaginous yeast, *Yarrowia lipolytica*, to increase oil content.

Expression of MGAT in Algal Cells *Chlamydomonas Reinhardtii*

A chimeric vector including *M. musculus* MGAT1 is used to stably transform algal cells. The genetic constructs designated 35S:MGAT1 is made by cloning the MGAT1 coding region into a cloning vector containing a Cauliflower mosaic virus 35S promoter cassette and a paramomycin-resistance gene (aminoglycoside-O-phosphotransferase VIII) expressed by a *C. reinhardtii* RBCS2 promoter. 35S:MGAT1 is introduced separately into a logarithmic culture of $5\times10^7$ cc503, a cell-wall-deficient strain of *Chlamydomonas reinhardtii* by a modified glass bead method (Kindle, 1990). Both vectors also contain the BLE resistance gene as a selectable marker gene. Briefly, a colony of non-transformed cells on a TAP agar plate kept at about 24° C. is grown to about $5\times10^6$ cells/mL over four days, the resultant cells are pelleted at 3000 g for 3 minutes at room temperature and resuspended to produce $5\times10^7$ cells in 300 uL of TAP media. 300 uL of 0.6 mm diameter glass beads, 0.6 μg plasmid in 5 μL and 100 μL of 20% PEG MW8000 are added and the mix is vortexed at maximum speed for 30 seconds, then transferred to mL of TAP and incubated for 16 hours with shaking in the dark. The cells are pelleted, resuspended in 200 L of TAP then plated on TAP plates containing 5 mg/L zeocin and incubated in the dark for 3 weeks. Transformed colonies are subcultured to a fresh TAP+zeocin 5 mg/L plate after which they are grown up under standard media conditions with zeocin selection. After harvesting by centrifugation, the cell pellets are washed with water before being freeze-dried for lipid class fractionation and quantification analysis as described in Example 1. The 35S:MGAT1 promoter is expressed constitutively in the transformed algal cells. The oil content of the cells is significantly increased.

The coding region of the mouse MGAT2 gene, codon optimised for expression in plant cells, is substituted for the MGAT1 in the construct mentioned above, and introduced into *Chlamydomonas*. Oil content in the resultant transgenic cells is significantly increased.

Expression of MGAT in Stably Transformed *Lupinus Angustifolius*

A chimeric vector including *M. musculus* MGAT1 is used to transform *Lupinus angustifolius*, a leguminous plant. Chimeric vectors 35S:MGAT1 and 35S: DGAT1 in *Agrobacterium* are used to transform *L. angustifolius* as described by Pigeaire et al. (1997). Briefly, shoot apex explants are co-cultivated with transgenic *Agrobacterium* before being thoroughly wetted with PPT solution (2 mg/ml) and transferred onto a PPT-free regeneration medium. The multiple axillary shoots developing from the shoot apices are excised onto a medium containing 20 mg/L PPT and the surviving shoots transferred onto fresh medium containing 20 mg/L PPT. Healthy shoots are then transferred to soil. The 35S promoter is expressed constitutively in cells of the transformed plants, increasing the oil content in the vegetative tissues and the seeds. A seed specific promoter is used to further increase the oil content in transgenic *Lupinus* seeds.

The coding region of the mouse MGAT2 gene, codon optimised for expression in plant cells, is substituted for the MGAT1 in the constructs mentioned above, and introduced into *Lupinus*. Seeds and vegetative tissues from the resultant transgenic plants are increased for oil content.

Expression of MGAT in Stably Transformed Cells of *Sorghum Bicolor*

A chimeric vector including *M. musculus* MGAT1 is used to stably transform *Sorghum bicolor*. Ubi:MGAT1 and Ubi:DGAT1 in *A. tumefaciens* strain AGL1 are used to transform *Sorghum bicolor* as described by Gurel et al. (2009). The *Agrobacterium* is first centrifuged at 5,000 rpm at 4° C. for 5 minutes and diluted to OD550=0.4 with liquid co-culture medium. Previously isolated immature embryos are then covered completely with the *Agrobacterium* suspension for 15 minutes and then cultured, scutellum side up, on co-cultivation medium in the dark for 2 days at 24° C. The immature embryos are then transferred to callus-induction medium (CIM) with 100 mg/L carbenicillin to inhibit the growth of the *Agrobacterium* and left for 4 weeks. Tissues are then transferred to regeneration medium to shoot and root. The Ubi promoter is expressed constitutively in cells of the transformed plants, increasing the oil content in at least the vegetative tissues.

The coding region of the mouse MGAT2 gene, codon optimised for expression in plant cells, is substituted for the MGAT1 in the constructs mentioned above, and introduced into *Sorghum*. Vegetative tissues from the resultant transgenic plants are increased for oil content.

Expression of MGAT in Stably Transformed Plants of *Glycine Max*

A chimeric gene encoding *M. musculus* MGAT1 is used to stably transform *Glycine max*, another legume which may be used for oil production. 35S:MGAT1 in *Agrobacterium* is used to transform *G. max* as described by Zhang et al. (1999). The *Agrobacterium* is co-cultivated for three days with cotyledonary explants derived from five day old seedlings. Explants are then cultured on Gamborg's B5 medium supplemented with 1.67 mgfL BAP and 5.0 mg/L glufosinate for four weeks after which explants are subcultured to medium containing MS major and minor salts and B5 vitamins (MS/B5) supplemented with 1.0 mg/L zeatin-riboside, 0.5 mg/L GA3 and 0.1 mg/L IAA amended with 1.7 mg/L or 2.0 mg/L glufosinate. Elongated shoots are rooted on a MS/B5 rooting medium supplemented with 0.5 mg/L NAA without further glufosinate selection. The 35S promoter is expressed constitutively in cells of the transformed plants, increasing the oil content in the vegetative tissues and the seeds.

The coding region of the mouse MGAT2 gene, codon optimised for expression in plant cells, is substituted for the MGAT1 in the constructs mentioned above, and introduced into Glycine. Vegetative tissues and seeds from the resultant transgenic plants are increased for oil content.

Expression of MGAT in Stably Transformed *Zea Mays*

A chimeric gene encoding *M. musculus* MGAT1 is used to stably transform *Zea mays*. The vectors comprising 35S:MGAT1 and 35S:DGAT1 are used to transform *Zea mays* as described by Gould et al. (1991). Briefly, shoot apex explants are co-cultivated with transgenic *Agrobacterium* for two days before being transferred onto a MS salt media containing kanamycin and carbenicillin. After several rounds of subculture, transformed shoots and roots spontaneously form and are transplanted to soil. The 35S promoter is expressed in cells of the transformed plants, increasing the oil content in the vegetative tissues and the seeds.

The coding region of the mouse MGAT2 gene, codon optimised for expression in plant cells, is substituted for the MGAT1 in the constructs mentioned above, and introduced into *Zea mays*. Vegetative tissues and seeds from the resultant transgenic plants are increased for oil content. Alternatively, the MGAT coding regions are expressed under the control of an endosperm specific promoter such as the zein promoter, or an embryo specific promoter obtained from a monocotyledonous plant, for increased expression and increased oil content in the seeds. A further chimeric gene encoding a GPAT with phosphatase activity, such as *A. thaliana* GPAT4 or GPAT6 is introduced into *Zea mays* in combination with the MGAT, further increasing the oil content in corn seeds.

Expression of MGAT in Stably Transformed *Elaeis Guineensis* (Palm Oil)

A chimeric gene encoding *M. musculus* MGAT1 is used to stably transform *Elaeis guineensis*. Chimeric vectors designated Ubi:MGAT1 and Ubi:DGAT1 in *Agrobacterium* are used. Following 48 hours vigorous culture, the cells are used to transform *Elaeis guineensis* as described by Izawati et al. (2009). The Ubi promoter is expressed constitutively in cells of the transformed plants, increasing the oil content in at least the fruits and seeds, and may be used to obtain oil.

The coding region of the mouse MGAT2 gene, codon optimised for expression in plant cells, is substituted for the MGAT1 in the constructs mentioned above, and introduced into *Elaeis*. Seeds from the resultant transgenic plants are increased for oil content.

Expression of MGAT in Stably Transformed *Avena Sativa* (Oats)

A chimeric gene encoding *M. musculus* MGAT1 is used to stably transform *Avena sativa*, another monocotyledonous plant. Chimeric vectors designated Ubi: MGAT1 and Ubi: DGAT1, as described above and both containing a Ubi:BAR selectable marker, are used to transform *Avena sativa* as described by Zhang et al. (1999).

The coding region of the mouse MGAT2 gene, codon optimised for expression in plant cells, is substituted for the MGAT1 in the constructs mentioned above, and introduced into *Avena*. Seeds from the resultant transgenic plants are increased for oil content.

Example 7

Engineering a MGAT with DGAT Activity

A MGAT with comparable DGAT activity may be engineered by performing random mutagenesis, targeted mutagenesis, or saturation mutagenesis on MGAT gene(s) of interest or by subjecting different MGAT and/or DGAT genes to DNA shuffling. DGAT function can be positively screened for by using, for example, a yeast strain that has an absolute requirement for TAG-synthesis complementation when fed free fatty acids such as H1246 which contains mutations in four genes (DGA1, LRO1, ARE1, ARE2). Transforming the MGAT variants in such a strain and then supplying the transformed yeast with a concentration of free fatty acids that prevents complementation by the wildtype MGAT gene will only allow the growth of variants with increased TAG-synthesis capability due to improved DGAT activity. The MGAT activity of these mutated genes can be determined by feeding labelled sn-1 or sn-2 MAG and quantifying the production of labelled DAG. Several rounds of directed evolution in combination with rational protein design would result in the production of a novel MGAT gene with similar MGAT and DGAT activities.

Example 8

Constitutive Expression of the *A. Thaliana* Diacylglycerol Acyltransferase 2 in Plants Expression of the *A. thaliana* DGAT2 in yeast (Weselake et al., 2009) and insect cells (Lardizabal et al., 2001) did not demonstrate DGAT activity. Similarly, the DGAT2 was not able to complement an *A. thaliana* DGAT1 knockout (Weselake et al., 2009). The enzyme activity of the *A. thaliana* DGAT2 in leaf tissue was determined using a *N. benthamiana* transient expression system as described in Example 1. The *A. thaliana* DGAT2 (accession Q9ASU1) was obtained by genomic PCR and cloned into a binary expression vector under the control of the 35S promoter to generate 35S: DGAT2. This chimeric vector was introduced into *A. tumefaciens* strain AGL1 and cells from cultures of these infiltrated into leaf tissue of *N. benthamiana* plants in a 24° C. growth room using 35S:DGAT1 as a control. Several direct comparisons were infiltrated with the samples being compared located on either side of the same leaf. Experiments were performed in triplicate. Following infiltration the plants were grown for a further five days before leaf discs were taken and freeze-dried for lipid class fractionation and quantification analysis as described in Example 1. This analysis revealed that both DGAT1 and DGAT2 were functioning to increase leaf oil levels in *Nicotiana benthamiana* (Table 6).

Leaf tissue transformed with the 35S:p19 construct (negative control) contained an average of 34.9 µg free fatty acids derived from TAG/100 mg dry leaf weight. Leaf tissue transformed with the 35S:p19 and 35S:DGAT1 constructs (positive control) contained an average of 126.7 µg free fatty acids derived from TAG/100 mg dry leaf weight. Leaf tissue transformed with the 35S:p19 and 35S:DGAT2 constructs contained an average of 310.0 µg free fatty acids derived from TAG/100 mg dry leaf weight.

The data described above demonstrates that the *A. thaliana* DGAT2 enzyme is more active than the *A. thaliana* DGAT1 enzyme in promoting TAG accumulation in leaf tissue. Expression of the DGAT2 gene resulted in 245% as much TAG accumulation in leaf tissue compared to when the DGAT1 was expressed.

Example 9

Co-Expression of MGAT and GPAT in Transgenic Seed

Yang et al. (2010) described two glycerol-3-phosphate acyltransferases (GPAT4 and GPAT6) from *A. thaliana* both having a sn-2 preference (i.e. preferentially forming sn-2 MAG rather than sn-113 MAG) and phosphatase activity, which were able to produce sn-2 MAG from G-3-P (FIG. 1). These enzymes were proposed to be part of the cutin synthesis pathway. GPAT4 and GPAT6 were not expressed highly in seed tissue. Combining such a bifunctional GPAT/phosphatase with a MGAT yields a novel DAG synthesis pathway using G-3-P as a substrate that can replace or supplement the typical Kennedy Pathway for DAG synthesis in plants, particularly in oilseeds, or other cells, which results in increased oil content, in particular TAG levels.

Chimeric DNAs designated pJP3382 and pJP3383, encoding the *A. thaliana* GPAT4 and GPAT6, respectively, together with the *M. musculus* MGAT2 for expression in plant seeds were made by first inserting the entire MGAT2 coding region, contained within a SwaI fragment, into pJP3362 at the SmaI site to yield pJP3378. pJP3362 was a binary expression vector containing empty FAE1 and FP1 expression cassettes and a kanamycin resistance gene as a selectable marker. The *A. thaliana* GPAT4 was amplified from cDNA and cloned into pJP3378 at the NotI site to yield pJP3382 in which the GPAT4 was expressed by the truncated napin promoter, FP1, and the MGAT2 was expressed by the *A. thaliana* FAE1 promoter. Similarly, the *A. thaliana* GPAT6 was amplified from cDNA and cloned into pJP3378 at the NotI site to yield pJP3384 in which the GPAT6 was operably linked to the truncated napin promoter, FP1, and the MGAT2 was expressed by the *A. thaliana* FAE1 promoter. pJP3382 and pJP3383 were transformed into *A. thaliana* (ecotype Columbia) by the floral dip method. Seeds from the treated plants were plated onto media containing the antibiotic, kanamycin, to select for progeny plants (T1 plants) which were transformed. Transgenic seedlings were transferred to soil and grown in the greenhouse. Expression of the transgenes in the developing embryos was determined. Transgenic plants with the highest level of expression and which show a 3:1 ratio for transgenic:non-transgenic plants per line, indicative of a single locus of insertion of the transgenes, are selected and grown to maturity. Seeds are obtained from these plants (T2) which includes some which are homozygous for the transgenes. Fifty progeny plants (T2 plants) from each line are grown in soil and the lipid content, TAG content and fatty acid compositions of the resultant seed is determined. The neutral lipid content, in particular the TAG content, of the seeds comprising both a MGAT and a GPAT4 or GPAT6 is substantially increased over the controls and over seeds comprising the MGAT alone or the *A. thaliana* DGAT1 alone. The MAG and DAG contents are also increased. The fatty acid composition of the lipid extracted from the seeds is modified, in particular the content of polyunsaturated fatty acids such as ALA is significantly increased.

Example 10

Testing the Effect of GPAT4 and GPAT6 on MGAT-Mediated TAG Increase by GPAT Silencing and Mutation The GPAT family is large and all known members contain two conserved domains, a plsC acyltransferase domain and a HAD-like hydrolase superfamily domain. In addition to this, *A. thaliana* GPAT4-8 all contain an N-terminal region homologous to a phosphoserine phosphatase domain. *A. thaliana* GPAT4 and GPAT6 both contain conserved residues that are known to be critical to phosphatase activity (Yang et al., 2010).

Degenerate primers based on the conserved amino acid sequence GDLVICPEGTTCREP (SEQ ID NO:228) were designed to amplify fragments on *N. benthamiana* GPATs expressed in leaf tissue. 3' RACE will be performed using these primers and oligo-dT reverse primers on RNA isolated from *N. benthamiana* leaf tissue. GPATs with phosphatase activity (i.e. GPAT4/6-like) will be identified by their homology with the N-terminal phosphoserine phosphatase domain region described above. 35S-driven RNAi constructs targeting these genes will be generated and transformed in *A. tumefaciens* strain AGL. Similarly, a 35S:V2 construct containing the V2 viral silencing-suppressor protein will be transformed in *A. tumefaciens* strain AGL. V2 is known to suppress the native plant silencing mechanism to allow effective transient expression but also allow RNAi-based gene silencing to function.

TAG accumulation will then be compared between transiently-transformed leaf samples infiltrated with the following strain mixtures: 1) 35S:V2 (negative control); 2) 35S:V2+ 35S:MGAT2 (positive control); 3) 35S:V2+GPAT-RNAi; 4) 35S:V2+GPAT-RNAi+35S:MGAT2. It is expected that the 35S:V2+GPAT-RNAi+35S:MGAT2 mixture will result in less TAG accumulation than the 35S:V2+35S:MGAT2 sample due to interrupted sn-2 MAG synthesis resulting from the GPAT silencing.

A similar experiment will be performed using *A. thaliana* and *N. benthamiana* GPAT4/6-like sequences which are mutated to remove the conserved residues that are known to be critical to phosphatase activity (Yang et al., 2010). These mutated genes (known collectively as GPAT4/6-delta) will then be cloned into 35S-driven expression binary vectors and transformed in *A. tumefaciens*. TAG accumulation will then be compared between transiently-transformed leaf samples infiltrated with the following strain mixtures: 1) 35S:p19 (negative control); 2) 35S:p19+35S:MGAT2 (positive control); 3) 35S:p19+GPAT4/6-delta; 4) 35S:p19+GPAT4/6-delta+35S:MGAT2. It is expected that the 35S:p19+GPAT4/6-delta+35S:MGAT2 mixture will result in less TAG accumulation than the 35S:p19+35S:MGAT2 sample due to interrupted sn-2 MAG synthesis resulting from the GPAT mutation. Whilst the native *N. benthamiana* GPAT4/6-like genes will be present in this experiment it is expected that high-level expression of the GPAT4/6-delta constructs will outcompete the endogenous genes for access to the G-3-P substrate.

TABLE 6

Fatty acid profile and quantification of TAG in triplicate *Nicotiana benthamiana* leaf tissue transiently transformed with the 35S:p19, 35S:DGAT1 and 35S:DGAT2 constructs.

| Sample | C16:0 | 16:1w13t | C16:1d7 | 16:3w3 | C18:0 | C18:1 | C18:1d11 | C18:2 |
|---|---|---|---|---|---|---|---|---|
| P19 | 44.7 | 0.1 | 0.0 | 0.0 | 33.9 | 1.2 | 0.0 | 6.5 |
|  | 44.1 | 1.7 | 0.0 | 0.0 | 15.3 | 2.0 | 0.0 | 15.2 |
|  | 43.3 | 1.5 | 0.0 | 0.0 | 10.5 | 1.5 | 0.0 | 17.2 |
| P19 + AtDGAT1 | 36.3 | 0.5 | 0.1 | 0.4 | 11.6 | 2.3 | 0.3 | 17.8 |
|  | 33.6 | 0.5 | 0.1 | 0.4 | 11.2 | 2.9 | 0.3 | 23.1 |
|  | 36.8 | 0.5 | 0.0 | 0.0 | 12.4 | 2.9 | 0.4 | 21.3 |

TABLE 6-continued

Fatty acid profile and quantification of TAG in triplicate *Nicotiana benthamiana* leaf tissue transiently transformed with the 35S:p19, 35S:DGAT1 and 35S:DGAT2 constructs.

| | | | | | | | | |
|---|---|---|---|---|---|---|---|---|
| P19 + AtDGAT2 | 18.6 | 0.3 | 0.1 | 0.5 | 9.3 | 7.7 | 0.4 | 28.0 |
| | 17.5 | 0.3 | 0.1 | 0.3 | 10.2 | 9.9 | 0.5 | 32.7 |
| | 18.4 | 0.3 | 0.1 | 0.3 | 9.8 | 7.5 | 0.5 | 32.3 |

| Sample | C18:3 | C20:0 | 20:1d11 | 20:2 | 20:3n3 | C22:0 | C24:0 | µg/100 mg DW |
|---|---|---|---|---|---|---|---|---|
| P19 | 12.7 | 0.9 | 0.0 | 0.0 | 0.0 | 0.0 | 0.0 | 43.29 |
| | 19.5 | 2.2 | 0.0 | 0.0 | 0.0 | 0.0 | 0.0 | 23.12 |
| | 23.9 | 2.2 | 0.0 | 0.0 | 0.0 | 0.0 | 0.0 | 38.35 |
| P19 + AtDGAT1 | 24.5 | 3.6 | 0.0 | 0.0 | 0.2 | 1.5 | 0.2 | 144.77 |
| | 21.5 | 3.8 | 0.0 | 0.0 | 0.2 | 1.5 | 0.9 | 145.34 |
| | 19.3 | 3.9 | 0.0 | 0.0 | 0.0 | 1.5 | 1.0 | 90.04 |
| P19 + AtDGAT2 | 33.1 | 1.1 | 0.2 | 0.1 | 0.1 | 0.2 | 0.3 | 439.25 |
| | 26.5 | 1.2 | 0.1 | 0.0 | 0.1 | 0.2 | 0.4 | 282.50 |
| | 29.1 | 1.2 | 0.0 | 0.0 | 0.0 | 0.3 | 0.2 | 208.40 |

It will be appreciated by persons skilled in the art that numerous variations and/or modifications may be made to the invention as shown in the specific embodiments without departing from the spirit or scope of the invention as broadly described. The present embodiments are, therefore, to be considered in all respects as illustrative and not restrictive.

All publications discussed and/or referenced herein are incorporated herein in their entirety.

Any discussion of documents, acts, materials, devices, articles or the like which has been included in the present specification is solely for the purpose of providing a context for the present invention. It is not to be taken as an admission that any or all of these matters form part of the prior art base or were common general knowledge in the field relevant to the present invention as it existed before the priority date of each claim of this application.

REFERENCES

Abdullah et al. (1986) Biotech. 4:1087.
Alvarez et al. (2000) Theor Appl Genet. 100:319-327.
Al-Mariri et al. (2002) Infect. Immun. 70:1915-1923.
Bao and Ohlrogge (1999) Plant Physiol. 120:1057-62.
Bartlett et al. (2008) Plant Methods 4:22.
Baumlein et al. (1991) Mol. Gen. Genet. 225:459-467.
Baumlein et al. (1992) Plant J. 2:233-239.
Benghezal et al. (2007) Journal of Biological Chemistry 282: 30845-30855.
Bligh and Dyer (1959) Canadian Journal of Biochemistry and Physiology 37:911-7.
Bouvier-Nave et al. (2000) European Journal of Biochemistry/FEBS 267:85-96.
Bradford (1976) Anal. Biochem. 72:248.
Broothaerts et al. (2005) Nature 433:629-633.
Broun et al. (1998) Plant J. 13:201-210.
Cadwell and Joyce (1992) PCR Methods Appl. 2:28-33.
Cao et al. (2003) J. Biol. Chem. 278:13860-13866.
Cao et al. (2007) J. Lipid Res. 48:583.
Cheng et al. (1996) Plant Cell Rep. 15:653-657.
Cheng et al. (2003) J. Biol. Chem. 278, 13611-13614.
Chikwamba et al. (2003) Proc. Natl. Acad. Sci. U.S.A. 100: 11127-11132.
Chung et al. (2006) BMC Genomics 7:120.
Clough and Bent (1998) Plant J. 16:735-743.
Coco et al. (2001) Nature Biotechnology 19:354-359.
Coco et al. (2002) Nature Biotechnology 20:1246-1250.
Comai et al. (2004) Plant J 37: 778-786.
Courvalin et al. (1995) Life Sci. 318:1209-1212.
Coutu et al. (2007) Transgenic Res. 16:771-781.
Crameri et al. (1998) Nature 391:288-291.
Darji et al. (1997) Cell 91:765-775.
Deshpande and Mukund (1992) Appl. Biochem. Biotechnol., 36:227.
Dietrich et al. (1998) Nature Biotech. 18:181-185.
Eggert et al. (2005) Chembiochem 6:1062-1067.
Ellerstrom et al. (1996) Plant Mol. Biol. 32:1019-1027.
Fennelly et al. (1999) J. Immunol. 162:1603-1610.
Fujimura et al. (1985) Plant Tissue Culture Lett. 2:74.
Ghosal et al. (2007) Biochimica et Biophysica Acta 1771: 1457-1463.
Ghosh et al. (2006) International Symposium on Plant Lipids, Abstract.
Glevin et al. (2003) Microbiol. Mol. Biol. Rev. 67:16-37.
Grant et al. (1995) Plant Cell Rep. 15:254-258.
Grillot-Courvalin et al. (1998) Nature Biotech. 16:862-866.
Grillot-Courvalin (1999) Curr. Opin. Biotech. 10-477-481.
Gould et al. (1991) Plant Physiol. 95:426-434.
Gurel et al. (2009) Plant Cell Rep. 28:429-444.
Harayama (1998) Trends Biotechnol. 16: 76-82.
Hellinga (1997) Proc. Natl. Acad. Sci. 94(19):10015-10017.
Henikoff et al. (2004) Plant Physiol 135: 630-636.
Hense et al. (2001) Cell Microbiol. 3:599-609.
Hinchee et al. (1988) Biotechnology 6:915-922.
Hirayama and Hujii K (1965) Agricultural and Biological Chemistry 29:1-6.
Horvath et al. (2000) Proc. Natl. Acad. Sci. U.S.A. 97:1914-1919.
Izawati et al. (2009) J. Oil Palm Res, 21:643-652.
Jako et al., (2001) Plant Physiol. 126:861-874.
Jézéquel et al. (2008) Biotechniques 45:523-532.
Lacroix et al., (2008) Proc. Natl. Acad. Sci. U.S.A. 105: 15429-15434.
Leung et al. (1989) Technique 1:11-15.
Kindle (1990) Proc. Nat. Acad. Sci. USA 87: 1228-1232.
Koziel et al., (1996) Plant Mol. Biol. 32:393-405.
Kunik et al. (2001) Proc. Natl. Acad. Sci. U.S.A. 98:1871-1876. U.S.A. 105: 15429-15434.
Lakshminarayana et al. (1984) Journal of the American Oil Chemists Society 61:1249-1253.
Lardizabal et al., (2001) J. Biol. Chem. 276:38862-38869.
Larkin et al. (1996) Transgenic Res. 5:325-335.
Murashige and Skoog (1962) Physiologia Plantarum 15:473-497.
Ness et al. (2002) Nature Biotechnology 20:1251-1255.

Niedz et al. (1995) Plant Cell Reports 14:403.
Ostermeier et al. (1999) Nature Biotechnology 17:1205-1209.
Ow et al. (1986) Science 234:856-859.
Panekina (1978) Chemistry of Natural Compounds 14:33-36.
Perez-Vich et al. (1998) JAOCS 75:547-555
Perrin et al., (2000) Mol Breed 6:345-352.
Perry and Harwood (1993) *Phytochemistry* 33:329-333.
Phillips et al. (2002) Journal of Food Composition and Analysis 12:123-142.
Pigeaire et al. (1997) Mol. Breed. 3:341-349.
Potenza et al. (2004) In Vitro Cell Dev. Biol. Plant 40:1-22.
Powell et al. (1996) Vaccines 183, Abstract.
Prasher et al. (1985) Biochem. Biophys. Res. Commun. 127:31-36.
Rajasekharan et al. (2006) International Symposium on Plant Lipids, Abstract.
Saha et al. (2006) Plant Physiol. 141:1533-1543.
Schaffner et al. (1980) Proc. Natl. Acad. Sci. U.S.A. 77:2163-2167.
Shiau et al. (2001) Vaccine 19:3947-3956.
Sieber et al. (2001) Nature Biotechnology 19:456-460.
Sizemore et al. (1995) Science 270:299-302.
Slade and Knauf (2005) Transgenic Res. 14: 109-115.
Stobart et al. (1997) Planta 203:58-66.
Stalker et al. 1988 Science 242: 419-423.
Stemmer (1994a) Proc. Natl. Acad. Sci. USA 91:10747-10751.
Stemmer (1994b) Nature 370(6488):389-391.
Thillet et al. (1988) J. Biol. Chem. 263:12500-12508.
Tingay et al. (1997) Plant J. 11:1369-1376.
Toriyama et al. (1986) Theor. Appl. Genet. 205:34.
Tumaney et al. (2001) J. Biol. Chem. 276:10847-10852.
Tzfira and Citovsky (2006) Curr. Opin. Biotech. 17:147-154.
Weiss et al. (2003) Int. J. Med. Microbiol. 293:95:106.
Weselake et al. (2009) Biotechnology Advances 27:866-878.
Winans et al. (1988) Journal of Bacteriology 170:4047-4054.
Wood et al. (2009). Plant Biotech. J. 7: 914-924.
Yang et al. (2003) Planta 216:597-603.
Yang et al. (2010) PNAS 107:12040-12045.
Yen and Farese (2003) J. Biol. Chem. 278:18532-18537.
Yen et al. (2002) Proc. Natl. Acad. Sci. U.S.A. 99:8512-8517.
Yen et al. (2005) J. Lipid Res., 46: 1502-1511.
Voinnet et al. (2003) Plant J. 33:949-956.
Volkov et al. (1999) Nucleic acids research 27(18):e18.
Zhang et al. (1999) Plant Cell Reports 18:959-966.
Zhang et al. (1999) Plant Cell, Tissue and Organ Culture 56:-46.
Zheng et al. (2003) The Plant Cell 15:1872-1887.
Zhao et al. (1998) Nature Biotechnology 16:258-261.

SEQUENCE LISTING (233 sequences)

SEQ ID NO: 1 - DNA, 1011 bp, Mus musculus
atgatggttgagttcgctcctcttaacactcctcttgctagatgccttcaaactgctgctgttcttcaatgggttctctctttcttgctccttgttcaagtgtgcatcggaatcatggttatgctcgttctctacaactactggttcctctacatcccttacctcgtttggttctactacgattggagaactcctgagcaaggtggaagaagatggaactgggttcaatcttggcctgtttggaagtacttcaaagagtacttccctatctgcctcgttaagactcaggatcttgatcctggacacaactacatcttcggattccatcctcatggaatcttcgtgcctggtgctttcggaaacttctgtactaagtacagcgacttcaagaagcttttccctggattcacctcttacctccatgttgctaagatctggttctgcttcccactcttcagagaatacctcatgtctaacggacctgtgtctgtgtctaaagaatctctctctcacgttctctccaaggatggtggtggaaacgtttcaatcatcgttcttggaggtgctaaagaggctcttgaggctcatcctggaactttcactttgtgtatcagacagcgtaagggattcgttaagatggctcttactcacggtgcttctcttgttccagttttctcattcggagagaacgatctctacaagcagatcaacaaccctaagggatcttggcttagaactatccaggatgctatgtacgactctatgggagttgctttgcctcttatctacgctagaggaatcttccagcactacttcggaatcatgccttacagaaagctcatctacaccgttgttggtagacctatccctgttcaacagatccttaaccctacttctgagcagatcgaggaacttcatcagacttaccttgaggaactcaagaagttgttcaacgagcacaagggaaagtacggaatccctgagcatgagactctcgttttcaagtgatga

SEQ ID NO: 2 - DNA, 1008 bp, Mus musculus
atggtcgagttcgctccacttcttgttccttgggagagaagattgcagactttcgctgttcttcagtgggttttctcattccttgctcttgctcaactctgcatcgttatcttcgttggactcttgttcaccaggttctggcttttctctgttctttacgctacctggtggtacttggattgggataagcctagacaaggtggtagacctatccaattcttcagaagattggccatctggaagtacatgaaggattacttccctgtgtctctcgttaagactgctgagcttgatcctagccgtaactacattgctggattccatcctcatggtgttcttgctgctggtgctttccttaacctctgtactgagtctactggattcacctctttgttccctggaatcagatcctaccttatgatgcttaccgtttggttcagggctccattcttcagagattacatcatgtctggtggactcgtgtctagcgagaaagtttctgctgatcacatccttagcagaaagggtggtggaaaccttcttgctatcatcgttggaggtgctcaagaggctcttgatgctagacctggtgcttacagacttctcttgaagaaccgtaagggattcatcagacttgctcttatgcatggtgctgctcttgttcctatcttctcattcggagagaacaacctcttcaaccaggttgagaacactcctggaacttggcttagatggatccagaacagactccaaaagattatgggaatcagccttccacttttccatggaaggggagttttccaatactctttcggactcatgcctttcagacagcctatcactactatcgttggaaagcctatcgaggttcaaatgactcctcagccttctagagaggaagttgatagacttcaccagcgttacatcaaagagttgtgcaagcttttcgaggaacacaagctcaagttcaacgttccagaggatcagcatcttgagttctgctaatga

SEQ ID NO: 3 - DNA, 1008 bp, Ciona intestinalis
atgtgggagttcgcccctcttagaatccctatgatcagaagattgcagacccttgctgtttctcacttcgtgttctgtttcttggctcttgctgctacttgcactcttcttactatctatatcaccctcttcaccagctactggcctatcactactgcttacctcgttttcttgttcctcgatcgtaacactcctgagtctggtggtagaagatctgagtgggttagaaactggtctttgtggaagtggatgtctgattacttcccttgtacccttcacaagaccgttgatcttgatcctaagaggaactacatcttcggaatccatcctcatggtgttctctgtatcggatctttcactcacttctctaccaacggatctggattctctcatgttttccctggattcacctcctaccttactatgcttccattctggttcaagatgcctttcttcagggattacgtgatgtctggtggacttactcctgctactaggaaggctatcaagcacactatcactagacctggtggtggacatatctgttgtattatccctggtggtgctcctgagtctcttaacgctagaccaggtgatgttgttcttttgcttaagcagagactcggattccttaagcttgctatcactaacggtgttcctcttgttcctgtgttctctttcggtgatcatgctctttgggagcaaaagcctaaccctcctggatctcttatcagaagattccaggactctagccaaaagtggatgcaagttgctctccctgttttccatgctagaggaatcttccagtacaacttcggactcatcccttacagaagatctgttcacactgttgttggagagcctatcgaagttcctcaaaactctaaccctacctctgaggatctcatgtctcttcaagaggactacatcaacagactcagggctatcttcgatgagcacaagtctaagtacctccctgaggattgcaagctcatcatcaactgatga

SEQ ID NO: 4 - DNA, 1020 bp, Tribolium castaneum
atgaagatcctcggaatcaagttcgctcctcttcatatccctcttgagagaagattgcagactcttgctgctggatgttggttcactactcttgctttcggaactttcatcggaaccttcatctgggtttacgtgttcttcaccaggttctggtacttgtctgttctttacgccaccatcatctacctcgagaagtctaagtgtgagaagggtggtagacctatcgagtggatcagacattggggatggtggtactacctcaagaactacttcccttgcaagctcgatttcgttcctggacttactttcgatcctaagaggaactacctcttcgcttgttaccctcatggaatcctccctgctggacctttcaacactatcggatctccatactctgagttcagcaagcttttcccaaagttcagagtgagactcgttatccttcaccagcatttcttcatcccattccttagagagatcgcttacggaactggtggaatctctgcttctgctaagtctcttaaccacgttctcggatctccagagggaggttacattgctgttcttatgcctggtggtgctgttgaggcttacaactctagacctggacagtacagaatcatcctcaagaacagaaagggattcgttaagctcgctctcagaaacggatctcctcttgttcctgttatctctttcggagagcctgagcttttcgatcaagttgagggaagaaccctcagaaagatccaagagtctatcagaaagtaccttggactcgctcctgttatcttctctggaagaggattcttccagtactctttcggagttatccctcaaagaaggcctatcactactgttgttggacaccctatcgaggttacaaagatcgagaagcctaccaacgaggaagttgacgagcttcacaaaaagtacatgcaagagcttgagaacttgttcgaagagtacaagttcaagtacctcgagaaccctaaggatatccatcttgagttcgagtgatga

SEQ ID NO: 5 - DNA, 867 bp, Danio rerio
atgctcggagccctttacgctggatggctttaccttgatagagatacaccttcttgcggaggtagaagatctcaatgggttagatcttggaggatctggatgcacttcagagattacttccctatcaccctcgttaagaccgttgatcttgatcctaggcacaactaccttctcggattccatcctcatggtgttcttgttgctggtggattcggaaacttctgtactgaggcttctggattctctcaaatgttccctggacttaccccttaccttcttatgcttccattctggttcagggtgccattcttccgtgagtacatcatgtgcggaggacttgtttcttctgagaaggcttctgcttcttaccttcttggacatcctggtggtggacaagctgctgttatcgctgttggaggtgctcctgagtctcttgaggctagacctggtgctcttactcttcaacttcttcagaggaagggattcatcaagcttgctcttaagcacggtgcttggcttgttccagttttctcattcggagagaacgagcttttcgaccaaatggaaaaccctgctggatctgctctcagaagaatgcaagaaagactccagaggattatgggagttgctctcccacttttccatgctaggggagttttccaatactctttcggacttctcccatacagaaagcctatccataccgttgttggtagacctatccctgtttctcaaactccttgcccttctaaagaggatatcgacgctctccacactctctacatgcaaggacttacccaggtgttcgaggaaaacaagaagcactacggaatcgctgatgataagcaccttaagttcacctgatga

SEQ ID NO: 6 - DNA, 762 bp, Danio rerio
atgagggactacttccctatcagacttatcaagaccgctgatctcgacaccagaaagaactacgttatgggattccatcctcacggaatccttgttgctggtgcttttactaacttctgcactgaggctaccggattctctaagttgttccctggaatcaagagcaaccttcttatgcttcctctttggttccgtgctccattcttcagagactacatcatgtctgctggactcgttccttctgacaaagagtctgcttcttacctccttagaagaaagggtggtggaaacgctgttgttatcgctgttggaggtgctcctgaggctcttgatgctcatcctggtgattacactgttcaccttgctaacaagaagggattcatcaagcttgctatcgagcatggtgctgatcttgttcctatctactctttcggagagaacgaggttttcgatcaagttcaaaaccctagaggaacctggcttcgttacatccaagaaagactccagaggattatgggagtttctcttccacttttccacgctaggggagttttccagtacactttcggacttatgccttaccgtaagcctatcaacaccgttgttggtagacctatccctgttgagaagaacgagaagcctactgctgaggaacttgatgtttaccatcagcgttacatggatgagcttgctagacttttcgaggatcacaagggaaactacggtgttcctgaggatactcatctcgttttccagtgatga

SEQ ID NO: 7 - DNA, 1008 bp, Mus musculus
atgatggtcgagttcgcgccactcaacaccccgctggcacggtgcctacagaccgctgcggtgctgcagtgggtcctgtccttcctcctgctcgtgcaggtgtgcattggaattatggtgatgctggtcctgtacaactattggttcctttacatcccatatctggtctggttttactatgactggagaaccccagagcaaggaggcagaagatggaactgggtccaaagctggcctgtgtggaagtattttaaggagtattttccaatctgtcttgtcaaaacgcaggatttggatccgggtcacaattatatatttgggtttcaccctcatggaatattcgtgcctggagcctttggaaatttttgtacaaaatactcggacttcaagaagctatttcctggctttacatcgtatctccacgtggccaagatctggttctgtttcccgttgttccgagaatatctgatgagtaacgggccggtttcagtgtctaaggagagtttgtctcatgtgctgagcaaggatggaggtggcaatgtctcaatcattgtcctcggaggtgcaaaggaggcgctggaggctcacccaggaacattcaccctgtgcatccgccagcgcaaagggtttgttaagatggccttgacccatggtgccagtttggttccagtattttcttttggtgaaaatgatctatataagcaaattaacaaccccaaaggctcctggctacgaactatacaagacgcaatgtatgattcaatgggagtagccttgccactgatatatgccagaggaattttccagcactactttggcataatgccctatcggaagctgatctacactgttgttggccgccctatccctgttcagcagattctgaacccgacctcagagcagattgaagagctgcatcagacatacctagaggagctaaagaaactattcaatgaacacaaagggaaatatgggattccggagcacgaaactctggtatttaaataa

SEQ ID NO: 8 - DNA, 1093 bp, Homo sapiens
cgtgggtgcaggctgcagtggctggcgccgtcctcgcccggccaggccatgaaggtagagtttgcaccgctcaacatccagctggcgcggcggctgcagacggtggccgtgctgcagtgggtcctttcttttcttacagggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttgggctggtttcagtttccaagaaaagtgtgtcctacatggtaagcaaggagggaggtggaaacatctctgtcattgtccttgggggtgcaaaagaatcactggatgctcatcctggaaagttcactctgttcatccgccagcggaaaggatttgttaaaattgctttgacccatggcgcctctctggtcccagtggtttcttttggtgaaaatgaactgtttaaacaaactgacaaccctgaaggatcatggattagaactgttcagaataaactgcagaagatcatggggtttgctttgcccctgtttcatgccaggggagtttttcagtacaattttggcctaatgacctataggaaagccatccacactgttgttggccgcccgatccctgttcgtcagactctgaacccgacccaggagcagattgaggagttacatcagacctatatggaggaacttaggaaattgtttgaggaacacaaaggaaagtatggcattccagagcacgagactcttgttttaaaatgacttgactataaaaaaaaattaaaaaataaaaataaatgac

SEQ ID NO: 9 - DNA, 1093 bp, Pan troglodytes
cgtgggtgcaggctgcagtggctggcgccgtcctcgcccggccaggccatgaaggtagagtttgcaccgctcaacatccagccggcgcggcggctgcagacggtggccgtgctgcagtgggtcctttcttttcttacagggccgatgtccattggaatcactgtgatgctgatcatacacagctattcgttcctttacatcccttatttgatgtggctttactttgactggcataccccagagcgaggaggcaggagatccagctggatcaaaaattggactctttggaaacactttaaggactattttccaattcatctcatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgctgagtgttggcctggtttcagtttccaagaaaagtgtgtcctacatggtaagcaaggagggaggtggaaacatctctgtcattgtccttgggggtgcaaaagaatcactggatgctcatcctggaaagttcactctgttcatccaccagcggaaaggatttgttaaaactgctttgacccatggcgcctctctggtcccagtggtttcttttggtgaaaatgaactgtttaaacaaactgacaaccctgaaggatcatggattagaactgttcagaataaactacagaagatcatggggtttgctttgcccctgtttcatgccaggggagtttttcagtacaattttggcctaatgccctataggaaagccatccacactgttgttggccgcccgatccctgttcgtcagactctgaacccgacccaggagcagattgaggagttacatcagacctatatggaggaacttaggaaattgtttgaggagcacaaaggaaagtatggcattccagagcacgagactcttgttttaaaatgacttgactataaaaaaaaatttttaaataaaaataaatgac

SEQ ID NO: 10 - DNA, 1008 bp, Pan troglodytes
atgaaggtagagtttgcaccgctcaacatccagccggcgcggcggctgcagacggtggccgtgctgcagtgggtcctgaaatacctgctgctcgggccgatgtccattggaatcactgtgatgctgatcatacacagctattcgttcctttacatcccttatttgatgtggctttactttgactggcataccccagagcgaggaggcaggagatccagctggatcaaaaattggactctttggaaacactttaaggactattttccaattcatctcatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgctgagtgttggcctggtttcagtttccaagaaaagtgtgtcctacatggtaagcaaggagggaggtggaaacatctctgtcattgtccttgggggtgcaaaagaatcactggatgctcatcctggaaagttcactctgttcatccaccagcggaaaggatttgttaaaactgctttgacccatggcgcctctctggtcccagtggtttcttttggtgaaaatgaactgtttaaacaaactgacaaccctgaaggatcatggattagaactgttcagaataaactacagaagatcatggggtttgctttgcccctgtttcatgccaggggagtttttcagtacaattttggcctaatgccctataggaaagccatccacactgttgttggccgcccgatccctgttcgtcagactctgaacccgacccaggagcagattgaggagttacatcagacctatatggaggaacttaggaaattgtttgaggagcacaaaggaaagtatggcattccagagcacgagactcttgttttaaaatga

SEQ ID NO: 11 - DNA, 1008 bp, Canis familiaris
atgaaggtcgagtttgcgccgctccacatcccgctggcgcggcggctgcagacggccgcggtgctgcagtgggtcctgtccttcctgctgctcgcgcaggtgtgcatcggaatcatcgtggtactgatcgtgcacaactattggttcctctacgtcccttatctgacatggctttgccttgactggcggaccccagagcagggaggcaggagatccaactgggtcagaagctggaccgtttggaggtattttaaggactattttccaattcacctcatcaaaacttgggatttggatccaagtcacaactatatatttgggtttcacccccacggagtgcttgttgctggagcctttggaaatttttgtacgaatcattcagacttcgaggagctgtttcctggcttcactgcgtatcttcacgtgctcccattttggttccggtgtcctctctttcgagaatatctgatgactagcgggtcagtctcagtttctaagaaaagtgtgtcctatgtgctgagcaaggagggaggtggaaacatttcagtcattgttcttgggggtgcagaagaatcactggatgcccatcctggaaaattcactctgttcatccgccagcggaaaggatttgttaaagtggctttgacccatggtgcctccttggtcccggtgttttcttttggagaaaatgaactatttaagcaagttaacaaccctgaaggctcatggcttcgaactgtgcaggagaagctacagaagatcatgggatttgctttgcctctgttccatgccagagggatttttcaatacaattttggcctgatgccctataggaaacctatccacactgtggttggtcgcccaatccctgttcatcggactccgcacccaagcccgggacagattgaggagttgcatcagacctatatggaggagctaaggaaattatttgaagcacacaaaaggaagtacggtattcccgagcatgaaactctcatttttaaataa

SEQ ID NO: 12 - DNA, 1118 bp, Bos taurus
atgaaggtcgagtttgcgccactcaacatcccgctggcgcggcggctgcagacggctgcggtgctgcattggttgctgtccttcctgctgttcgcacaggtatgcctcggaattatcgtgttcctgatcatatacaactactggttcctctaccttccttacttgacatggctttactttgactggcaaaccccagagcaaggaggcagaagatctgaatgggtcagaaactgggccatttggaggtactttaaggactattttccaattcatctcatcaaaacctgggatttggatccgagtcacaactacatatttgggtttcacccccatggagtgcttgtggttggagcctttggaaacttctgtacaaattattcggccttcaaggagctgtttcccggctttacctcctatcttcacgtgctgccgtattggttccggtgtccgctcttccgggaatatctgatgagcagtgggccagtctcagtttccaagaaaagtgtgtgccacgtgttaagcaaagagggaggtggaaacatctcagtcattgtgctcgggggtgcagaggaatcactggatgcccatcctggaaagttcactctgttcatccgccagcggaagggattcgtgaaaattgctttgacccatggtgcttatttggtgccagtgttttcttttggtgaaaatgaactatttaaacaagttagcaatcccgaaggatcatggcttcgaaatgtgcaggagaaactacagaagatcatgggatttgctttgccactgttccacgccagaggaatttttcaatacaattttggcctaatcccctataggaagcccattcacactgttgttggccgcccaatccctgttcgtcagaccctgaacccaacctcagagcagattgaggagttgcatcagacctacatggaggagctgagaaaattatttgaagaacacaaagggaagtatggtattccagaaaatgaaactctcatttttagataactgttgtcttagaagtcatgcaagagagcgagagaacatcccactgaaagaaaagatattctaaataaatttttttctttgacaatggaatcaaatttgcaactgtaaaa

SEQ ID NO: 13 - DNA, 749 bp, Rattus norvegicus
ttgactcactaagggccagtttcagtttctaagaggagtttgtctcatgtgatgagcaaggaaggaggtgggaacatctcagtcattgtcatcgggggtgcgaaagagctactggagtccttccctggaagatattctctgtgccttcttcagcgcaaaggatttgttaagatcgccttgacccatggtgcccatttggttccagtgttttcttttggtgaaaatgaactatatagccaagtcgacaaccctaaaggctcatggcttcggactgcccaagacaaagtgtataacctaacggggttggccttgccactattctatgccagaggaattttccagaacagctttggcctaatgccctatcggaaattgatctacactgttgctgcggttggcacagcagctcgtttgactcagaagtcaaaccatcagaacgacagctcagtgtctgctgagaagggaaactcttttatttgttgtcaagtgggatggtgtgaccgagataggcagccattggccgccccatccctgttcagaagactctgcacccgaccccagagcagattgatgagctgcatcagacgtacatggaggagctaaggaaactcttcaatgaacataaagggaaatacggtattccggagcatgaaactctggtttttaaataaccgtcttcctccaagccatactgaaggaagacaagaaaacattgttgagaaaataaatattttaaataacttctctgt

SEQ ID NO: 14 - DNA, 1547 bp, Danio rerio
ttttttttttttttttcctgtttgagctgtctttattatcgtcctcgccattgagttcgctcctctgcgcgtgcctctgcgcaggcgcattcagacggccgcggtggtccagtgggtcttcagcttcttggctctggctcaggtgtgtctggccgcgttcgtgctgctgtgtctcagtgattggtggatgctcggagcgctgtatgctggttggctgtatctggaccgggacacgccctcatgtggaggtcggaggtcacagtgggtcagaagctggaggatctggatgcatttcagggattatttcccaatcacactggtcaagacggtggatctggacccgaggcacaattacctgctgggtttccatccgcacggtgttctggtggccggtggattcgggaacttctgcacggaggcgtccggattctcccagatgttcccgggactcacgccgtacctgctgatgctgccgttctggttcagggtgcccttcttcagagaatacatcatgtgcggagggctggtgtccagtgagaaggccagtgcgagttacctgctgggtcatccaggcgggggtcaagcggccgtcattgcagtgggcggagctccggagtctctggaggcgcggcctggagcactgacactgcaactgctgcagcgcaaaggcttcatcaaactcgccctcaaacacggagcgtggctggttccagtgttctcgtttggggagaacgagctcttcgaccagatggagaatcccgcaggctccgccctccgccgcatgcaggaacgcctccagaggataatgggcgtggctttgcctctctttcatgctagaggagttttccagtacagcttcgggctgctgccgtacaggaaacccatacacaccgtcgttggacgtcccattcctgtaagtcagactccgtgtcccagtaaagaagacatcgacgctcttcacacactctacatgcagggcctgacacaggtgtttgaggagaacaagaaacattacggcatcgcggacgacaaacatctgaagttcacctgaactgatctgtgtgtgtgtgtgcgcgtgcgtatgtgtttgtttgtgtgtgtgtgtgtgtgtgtgtgtgtgcgttgcatataatctagaatgattatctaccatctagttaaaggtcttggtacgaggggttgtgtagttgtgttgtcatgtgatatgacgatattcagaataacccacagcttgagctgaagtacggttactacacagtgtataaaacattaaggagatccttttactgttatcctccttcactacagtatggtaaatattgttactgtattttatgacttcattaaaacactatgtgaccgccattaagattattaaatgttcagattaaacaggtcatgaacactctgggttttacagatcttcaggattccctcctgtgcttaaatcagatttgttcttaatcagcaaatgtgtgttgatgtgtatgacaacagaaacacaaataaagcggtgctgtttattattttaaaaaaaaaaaaaaaaa

SEQ ID NO: 15 - DNA, 1279 bp, Caenorhabditis elegans
attcttcattggacctctacgaccaccacacagtcagtcatgttagatcgaacagaaagtgaagataagatgccacatctactaggagttgagtgggctccgctcaatattccgttggctcggcgtcttcaaactttgggagcacttcatttcttcttcatcactctcttcacaccagtactcgttctcaccgttccattctacatgttatataccgtactctggcctttgatctttctgtatgggctttggatgatttacgattggaattcaccaaagaagggagcctatatgagcaattggttccagagacaaagaattcattcgtggtatgccaactattttccagtcaaattgcacacaacatctgacatgccagaagaacataactatttgattgggtaccatccgcatggaataatttcaatggccgcattcatcaactttgcaacaaatggaactggaattctcgatactcttccacgaattcgtttccatttgtgcacacttgttggtcaattctggactccgtggagacgtgagtggggattgttgcacggaatgatagactgcagtcgagaaagcatcaagcacgttttggagcatgaaaagaaaggaaaagcagttgtattggtggttggtggagctgaagaagcacttgatgcacatccaggatgccatattttgactttgaaaaaaaggaaaggattcgtgaaaattgccctgcaaactggagctcaactggttccatgctattcattcggtgaaaatgatattttcaatcaagccgaaaatccaaagggatcaacaattcgacagttccaaacgataatgaaaagagtcttgggattctcccctccagcattctatgggagaggagtattcaactatacatttggtcttcttccattcagaaaacctatcaacactgttctcggcgctccaatttcagtgacaaagacagtgaatccaactcaagaacaaatcgacacacttcatcagacatacatggaccgtcttcatgagcttttcgaggagcacaagacaaaatacgatgtctctccaactacacaacttgttatcaattaaatattatctatttaatcacgtttgatgcacttttctcatatttacatctctattatacctcattctgcaatttagttcatattttcagccaatttttcaatattacgagttctcatgtcaaatatccccatcagattcagttactagttcagttatttttaatcgatctctattataagtttcgacacag

SEQ ID NO: 16 - DNA, 1089 bp, Caenorhabditis elegans
attcttcattggacctctacgaccaccacacagtcagtcatgttagatcgaacagaaagtgaagataagatgccacatctactaggagttgagtgggctccgctcaatattccgttggctcggcgtcttcaaactttgggagcacttcatttcttcttcatcactctcttcacaccagtactcgttctcaccgttccattctacatgttatataccgtactctggcctttgatctttctgtatgggctttggatgatttacgattggaattcaccaaagaagggagcctatatgagcaattggttccagagacaaagaattcattcgtggtatgccaactattttccagtcaaattgcacacaacatctgacatgccagaagaacataactatttgattgggtaccatccgcatggaataatttcaatggccgcattcatcaactttgcaacaaatggaactggaattctcgatactcttccacgaattcgtttccatttgtgcacacttgttggtcaattctggactccgtggagacgtgagtggggattgttgcacggaatgatagactgcagtcgagaaagcatcaagcacgttttggagcatgaaaagaaaggaaaagcagttgtattggtggttggtggagctgaagaagcacttgatgcacatccaggatgccatattttgactttgaaaaaaaggaaaggattcgtgaaaattgccctgcaaactggagctcaactggttccatgctattcattcggtgaaaatgatattttcaatcaagccgaaaatccaaagggatcaacaattcgacagttccaaacgataatgaaaagagtcttgggattctcccctccagcattctatgggagaggagtattcaactatacatttggtcttcttccattcagaaaacctatcaacactgttctcggcgctccaatttcagtgacaaagacagtgaatccaactcaagaacaaatcgacacacttcatcagacatacatggaccgtcttcatgagcttttcgaggagcacaagacaaaatacgatgtctctccaactacacaacttgttatcaattaa

SEQ ID NO: 17 - DNA, 1149 bp, Caenorhabditis elegans
tcagctttccactgaaaatgccgcaatttctcggaatagaatgggtggatctattctcatcaattcaacgtaaaaagacatacttgggagttgtctatcactttatgctcacttacccacttgcacttttcgtcaccattttgccatttttcttgcttttcactttccaatggcacattttggctctctacgcttgctggtacttctacgatatggattctccgaggagaggtggatattccagtgattgggtcagaaaatggcgtgtcaacgactggttcgcccaatacttcccaatcaacttgcacaaaactgccgaactctccacggacaagaactatctggttggaatccatcctcatggtatcatctccatggctgcatggtctaattttgccaccaatggaacgggaatctatgagaaattccctggaattcgctggaatttgtgcactttagcacttcagttcagaatggccatccgtcgtgagcttctccttctcaccggcctaatcgactgctccagagaatccattgaatatgtgcttgacaaatgtggccagaagggacgtgcagtggtattggtgattggaggagccgaagaagctttagatgctcatccaggctaccacacactcactttggcatcaagaaagggatttgttcgggaggctttgattactggtgcctacttggtcccggtgtattcttttggagagaatgacgtttttgaacagatggagaatccagttggctcacggctccgcaacttccaagaatggtgcaaaagcattttcggcatctcatatccaattttccatggtcgtggcttcttccaactaactttcggatatcttccattccgtaaaccaatcgataccgtagtcggagccccaattcccgttgaaaaagtggaaaatccgacgaaagagcaaatcgacgagcttcacaccatttattgtcaaaagttgacggagctgttcgatgagcacaaggaaaaatatggagtggagaaggacgtgccgttggtgctccggtagagcggaaaatttgaaatgttctgtgaaaagtgccagtttttgatgagatttctgtattttatcgtgccataatttttgtttttcgagccttgttttaagttgttacggt

SEQ ID NO: 18 - DNA, 1136 bp, Caenorhabditis elegans
atgctaaactaccaaattcacaaaaagctcaccgacatcaagtgggtgaacatcttctccccatgggatcgccagcgtgcctacttcgccttggtcgtctggttcgggctcatctacccattctgctgcctgtgccaggtggctccgtttgtgctctttttcaccggccagtggattattttgggtctctacgcagtttggtacctttacgatcgagaatctccgagaagaggaggatatcgggataattggttcagaaatttgtcgctgcacaagtggttcgccgagtattttcctgttaaacttcacaaaactgcggagttggatccaaaccaaaattatttattcggatatcatcctcatggaattctcggtgtcggagcgtggtcttgttttggatttgatgcgtgcaatgtgaagcaagtgttcaaaggcatccgcttcaacatctgcaccttgcccggcaacttcaccgcaatgttccgccgcgagatcctcctcagcatcggtatgatcgagagctccaaagaatccatcgagcacgtgctcaactccgaggaaaagggccgtgccgttgtaattgtcgtgggtggagccgctgaagctcttgaagctcacccagggaagcatactctaacactggcaaatcgcaaaggtttcgtgagagaagccgtgaagaccggagctcatctggtgccagtttatgcgtttggagagaatgacatatataagcaaattgacaacccggaaggctcgaaattacggaaaattcaagaatggggaaagaagaaaatgggaatttcactgccactaatctacggaagaggatattttcaaatggctcttgggcttcttccaatgagccgagctgtgaatgtagttgtcggagcgcctattcaagtggaaaaagagctcgatccttctaaggaagtcattgatgaaattcatggagtttatatggaaaagctcgccgagttatttgaagagcacaaggcaaagttcggagtttccaaggacactcggctcgtttttcagtgaaataacttttattttagattatttgtttgatgtttgatgtctgttatgttatcattttttatcaccaaatcgtgtaattttgtttacgggttcattac

SEQ ID NO: 19 - DNA, 1176 bp, Caenorhabditis elegans
atgagactccggctgagctcgatatctggaaaggcgaagcttcccgataaagaaatatgctcatcagtttcgagaatattggcaccattgcttgttccatggaagcgacgactcgagactcttgccgtgatgggtttcattttcatgtgggtaatcctaccaatcatggacctctgggttccattccacgtcttgttcaatactcgatggtggttccttgttccactctacgctgtctggttctactatgattttgatacaccgaaaaaagcttcaagaagatggaattgggccagaagacacgtagcctggaagtactttgccagctacttcccattgagattgatcaagactgctgaccttccggcggatcgtaattacatcattggctctcatcctcatggaatgttctcggttggtggttttactgcaatgagcaccaacgcgaccggatttgaagacaagttcccgggaataaaatctcacatcatgacgctaaatgggcaattttatttcccatttcgtcgagaattcggaataatgctcggtggaatcgaagtttcgaaagaatcacttgaatacactctaactaaatgtggaaaaggacgagcatgcgcaattgtcattggcggagcctcggaggctcttgaagctcatcccaataaaaatacattgacgttgatcaatcgacgtggtttctgcaaatatgctctgaagtttggagcagacctcgtaccaatgtacaatttcggagagaatgatttatacgagcagtatgaaaacccgaagggatctagattgcgagaagttcaggagaaaatcaaggacatgttcggattgtgtcccccattgctccgcggtcgatcgttgttcaaccaataccttatcggattgctgccgttccgaaaaccagttacaacagtcatgggaaggccaattcgagtcacccaaaccgacgagccaaccgttgagcagattgatgagctgcatgcaaaatattgtgatgctctctacaatctgttcgaggagtacaagcatcttcactccattcctcccgacactcatctcatcttccagtgactttttcacaaattttgtatattttgcacacagattgttttatcgccaagttaatgtatagtaatcttcttgtaaataaatcagataaacattaaa

SEQ ID NO: 20 - DNA, 1239 bp, Kluyveromyces lactis
atgggtaaggaacaaatcagaaagagacaaactaaaaaggtacgcaagggttcacaacccgtggcaaatggtaaatcttctgtagtaggggtctccaaagatgggaaaccagaattttgtgctattgatacgcccatagaaaggagacttcaaactctcagcgtagcatggtatgtcgaatgtattccgttaatgatcatcataatgttgtttgtttgggttaacccgttgatgtggtcgtttgtaataccatacaccatttattatttcatagaccggactgcctccaatgggaacgctgtgaagagacactccaagtggttccgatctctaaaggtctggttttatttccgtgattacttccctataagtatgcacaaaagcactgaactcgagccaacatttacaagtattgattccacagagctggaaaatgatgcgagtgagccaggctacctggatagctcacagcccgttttaccagataaatggtggaatcctttcagagaaaaggatgaaactgttagaccaacaggaccgaggtatatttttggctaccatccacatggtatagcagcattcggagcgtttggagcattcgctaccgaggcatgtaattggagtaaagttttcccaggcattccagtgtgtttgcttactttggtaaatcaatttcaaataccagtgtaccgtgattatttattggccttaggcataacatcggtcgctagaaaaaatgctatgaaagtacttgagaaaaattattcaatagccatcgtaattggaggtgccagtgaatcccttcttactaaccttggttcatctgatatcattttaagcaagcggaaaggttttgtgaagttggctttgcaaactgggaatgtgagtcttgtacctgtgtatggatttggtgaaactgatacttacaagattctgaagcttaaaaatgactctataataggcaggatacagatatggcttaaagagaactacagcttcactgtccctctatttttcgctcgtggtgtattcaattatgattttggtttactaccgtttagacatccagtcaatgttgttgttggaaaccctattcatattaaagaaaagatagatcatccaacaattgaggagattgatcattaccattccttatacattgaagaattgaaacgtctttacgatgataacaaggcaaaatttaactattcagaaaaaactttaaatatagtggaatga

SEQ ID NO: 21 - DNA, 1386 bp, Ashbya gossypii
atgcaggacagcatggatgacagcttgagggaggctgagggcagacaggacgactcggaggtcagcagcgggacgacactcggaagcagcaccccggaggacagcggggtgacggcgaagctgcgcaagaagtaccagatggcgtcggcactgctgcggcgggagctggaggagctgagcgtgtacgacgcgaagacggcgggggtaagcggccgcagcagcggcagcggcagcggcgggctggcgctgctgggcgggcgattccacgtggcgccgctgcggatccccgcgcggcggcggctgcagacgctggtggtggcgtggcacacgagctcgttcatctacatgacggtgctggtgctgtttctggcggcgaacccgctgatgtggtggttcatggtgccgtatatggtgtactacgtgtggaaccggtcgccggcgaacggcggagtggtgcggcggtactcgccgcggctgcggtcgctggcgctgtggcggtactactgcgagtactacccgatctcactgcacaagagcgaggacctggcgccgacgttcgtgccggacccgcggggggcggagccgcgcgagtggaagctgcggctgtggctgtggccgacgcgcgtggagctgctgaacttgacgctccagtggacgcgcgcgcggccgcaggttgcgacagggccgcgctacatcttcgggtaccacccgcacggcgtgggcgcactgggcgccttcggcgcgatcgcgaccgagggctgcaactggagcaaggtcttcgcgggcatcccggcctgcctgtgcacgctggtgaaccagttccagatccccatctaccgcgactacctgctgggcctcgggtgcacctccgtggcccgcaagaacgtgctcaaggtgctcgagcagaactactcggtctgcatcgtcgtgggcggcgcccaggaagccctgctcagccgtgtgggctccaccgagctcgtgctgaacaagcgcaagggcttcatcaagctcgcgctggagacgggcaacgtcaacctggtgcctatctacgccttcggcgagacagactgcttcaacgtgctcgacacgggcaacgagagctacctacgcaagttccagctgtggatcaagaagacctacggcttcaccatcccgttcttttttgcgcgcggtgtcttcaactatgacttcggcttcctgcccttcaggaatccgatcaacgtcgtcgtgggcaagcctgtgtacgtagacaagcgcagaacgaaccccaccatggaggaaatcgaccactaccacgacctgtacgtgcaggagctgcgcaatgtgttcgacaagaacaaacacaagttcggctacgccgggaaggaacttaaaatagtagagtag

SEQ ID NO: 22 - DNA, 1653 bp, Magnaporthe oryzae
atggccacggtagatgatacccagaaccatgtccaactgaatgcagagtccagcctaaacgaatttccgtaccaagcaagcgcggacaaggaggagtatccaagccttccttctgccccgctccctgacgtggacggcagctcccaaaatgggcatacagccgccaacgctgaccttccgccctcggagtcgaccgaacagccatggaacaaggtagccagtggcgacttcatccatgaaaccaagatgcccagtgaagaccgggacaaccttgccaggcccggcagtctaccaactcccgagccgagccgtagaggcagcaacacgctggtcggcagcccgcgtcagggcgacggattgcaaatgctcatggacgaattcgcagacgatgaatcctcagatacctcgtgggacattcacgagaccatcaggagtcgcacccaggccttggctgagaaggaccaccaggggatattctcaaatcagcggcgaggcaaccaggccgacgcgccagacacggtaaccagtgccaacgcttggttgccggctggcttcgaagacgacctggacgaagtgaccggtgctgacgacgagttcgagccaacccgtgggagtcgctggagagtgaggctggcgcccctggataccccttttcatcgccggatgcagaccctggtggttctgctacacgtcctcggcatgggaatcactttcagctttttctgcttcctatgcacgctccccctgttttggcctatcatcatcgcctacctcgtattcatcagactgtcgagagctggatccgatgggaagacaaaccgtcgcatagaatggctccgcagggctcgcatctggaagtactttgccgattacttccctgtcaagctacacaagacagccgacctgccccccacccgcaagtacatttttgcgattcatccacacggaatcatctcgcatggtgcctttgcctccttcgccacggaggccctcggcttctctgagaagtttcccggcatcacaaacagtgtgtgcactcttcacggcaacttcaagaccccgttctaccgcgagtatctgatggccatgggcctgatctcggtttcaaaggagtccattattaacactttgatgaccggcgggatcaacggtgaaggcatgggcagggccgtctccataattgtcggtggggcgcgagaggcactcgaggcctgccccaagacgatgcgcttgatactgaaacggcggggtttttgtcgcatggcactacgcaccggtgcagaccttgtgccggtgctctgctttggtgagaacgacctctaccaacagtgggggccgcaggatcatccgcgcttccgtcgcctgcaaatgaaggctctcgcgtacctaggctttgcggtccccgttctgaggggaaggggcgtcttcaactatgactttggagtccttcctcagcggcggccgatcaacgttgttgttggtgagcctatcaaggttgagcagtttcggggtagcggtaacattgagccacgcgtcgaggagctgtggaagctatattgccagaagcttcaggaactgtacgaccagaacaagcacgtctatttcaaggatcgtcaggaggatatgaggtttgttgactcggaggagttgtaa

SEQ ID NO: 23 - DNA, 1410 bp, Ciona intestinalis
gccataaaacgttgagaaaatgttttgtgttacgtcaagttactcattaactcaatgtaaagattgatatagccagagcaaattgtagttaagtagcgcatatacccaacttggaaactgctatatagttggtaaagcggattaggaaccatgtgggaattcgcaccgcttcgtattcctatgataagaagacttcaaacgttggctgtttctcattttgtgttctgctttcttgccttagctgccacatgcactttattgactatctacattactttgttcacttcatactggccgatcaccaccgcttaccttgtgttcttattcttggaccgaaacaccccggaatctggtggaagaagaagcgagtgggtgagaaattggagtctctggaaatggatgagcgattactttccttgtacgttgcacaaaaccgttgacctcgatccaaaaagaaactacatatttggcatccatccacatggggttttgtgcatcggatctttcactcacttctccacgaatggctccggattttcgcacgtttttccgggatttacatcttatcttacgatgttgcctttctggttcaaaatgcccttttttcgtgactatgttatgagcggcggtttgactccagccacaaggaaagccatcaaacacacaataacaaggccaggtggtgggcatatatgctgcattatacctggtggtgctccagaatctctaaacgcacggcctggagatgttgtattgttgctgaaacaaagacttggatttctcaagctggcaataacgaacggagttcctttggttcccgtgttttcatttggcgatcacgcgttgtgggagcagaaaccgaatccccccggttccctcatccgtaggttccaagatagctctcagaagtggatgcaagtcgctcttcccgttttccacgcacggggtatctttcagtacaattttggactaattccgtacaggcgtagcgtccataccgtagtgggcgagcccatagaagtgccacagaacagtaacccgacatcggaggaccttatgagtttgcaagaggattatattaatcgattgagagcaatttttgacgagcacaagagcaaatatctcccagaagattgcaaactgatcatcaactaaactaaactaaactatgcaaccaaagctttttaaattgagttagttatagtagtgtgaagtaagatagagcacctttagcaataatgctgtccaaatttcctggttcaaacaattaataacggacgggagtcgtgatgaaacggttttagaatactttaagtgtttttgtttactaccaaatgaaaagataaggtagaataaaagggtgtctcatcttcccccaccgtactatatatatacacgatcgaatcattg

SEQ ID NO: 24 - DNA, 1728 bp, Mus musculus
agcatggtggagttcgcccccctgttggtaccatgggagcgcaggctacagaccttcgcggtccttcagtgggtcttctccttcctggccttggcccagctctgcatcgtcatcttcgtaggcctcctattcacaaggttctggctcttctctgtcctgtatgccacctggtggtacctggactgggacaagccgcggcagggaggccggcccatccagttcttcagacgcttggccatatggaagtacatgaaggattatttccctgtctctttggtcaagacagctgagctggacccttcccggaactacatcgcgggcttccacccccatggagtcctagcggctggagcctttcttaacctgtgcactgaaagcacgggctttacctcgcttttcccgggcatccgctcctatctgatgatgctgactgtgtggttccgggcccccttcttccgagattacatcatgtctggggggctggtctcatcagaaaaggtgagtgccgatcacattctgtccaggaagggcggcgggaacttgcttgccatcatcgttgggggcgcgcaggaggcactggacgccaggcctggagcctacaggctgctgctgaagaatcgcaagggcttcatcaggctcgccctgatgcatggggcagctcttgtgccaatcttctcctttggagaaaacaacctgttcaaccaggttgagaacacccctggtacctggctgcgctggatccagaaccggctacagaagatcatgggcatctccctccctctcttccacggcagaggtgtcttccagtacagctttggcctcatgcccttccgccagcccatcaccaccatagtggggaagcccatcgaggtgcagatgacaccacagccctcaagggaggaggtggaccggcttcaccagcgctatatcaaggagctctgcaagctctttgaggagcacaaactcaagttcaacgtccctgaggaccagcatctggagttctgctaagtgtctccagccggaagacagctgcatctgagcgcctgcaggagtgtgggattagggggacttccacagccaccagacactcctacaaacctagccacaactgccaagatggaagagggggcagctcctaatcctgggatttgaacctgcagccaaagctctgaggtctccctgtccttggcctgtctgcacatctgtagaatgggggaaaagcaggcagagagaaattcctgaggtctcttcccacagttgtaatgtcattcaaacatgaccaaaggacaaacagggagaaagagaacaaaactgttcttcatctacccttgagggacagtgcaagagaagccagcaccccaggcctccctgtgcatgctccctgatgctgcttcttccctctgaggcagagacggggagccaagtctgccctggcacctactctatgtttcttcagattctgggtcctctgagctatgataccaaaggagcccagaaggcagataaggagggcaggggtcactgactatgaccgagggtaggtctccttcccatatcctgagcctcagtttccccagccttaatgacctgggagcgccacactgctcaccacagaggctccaccagagagcctcttactcatgctttctagtgaactccagcctctgtcttggcactgaagggcagcactgtacatgttacctcaataaatgaaaggagtctgtctta

SEQ ID NO: 25 - DNA, 1005 bp, Homo sapiens
atggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctga

SEQ ID NO: 26 - DNA, 1128 bp, Pan troglodytes
aaaaacctgtgggtgcctcagaccacagcagagctcacagaacctgcgggagccaggctgacccgccagcatggtagagttcgcacccttgtttgtgccgtgggagcgcaggctgcagacacttgctgtcctacagtttgtcttctccttcttggcactggctgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggtttctcttcgatcttccccggtatccgtccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgag

SEQ ID NO: 27 - DNA, 1005 bp, Canis familiaris
atggtgaagtttgcaccactgttcgtgccatgggagcgcaggctgcagaccttcatggtcctgcagtgggtcttctccttcctggccctggcccagatctgcactgtggtcttcgtaggcctcctgttcacaaggttctgggtggtcagcgtcctgtatgccgcctggtggtaccgggaccgggacacgccgaggcaggggggcaggcccgtccaagccctgaggcgctgcttcttgtggaagtacatgagggactacttccccgtcacgctggtcaagactgctgagctggacccctcccggaactaccttgctggcttccacccccacggggtcctggccgcaggagcctttgtcaacctgtgcacggagagcacgggcttccctttgctcttccctggcatccgctcccatctgatgatgctgaccttgtggttccgggtccctttcttcagggattacatcatgtccgggggcctggtcacttcggacaaggagagcgctgctcacatcctgagcaggaaggagggtggcaatctgctggccatcattgtagggggtgcccaggaggcgctgaacgccaggcctggagactccacgcttctgctccggaaccgcaagggcttcatcagacttgccctgatgcacggggcagctctggtgccgatcttttcctttggggagaatgagctatttgaccaggttgagaactctcctggctcctggttgcgtaggattcagaaccggctgcagaagatcatgggtatctccctcccgctcttccatggccgtggtgtcttccagtacagctttggctttataccctaccgccagcccatcaccaccgtggtgggaaagcccatcgaggtgcagaagacactgtgtccctcaaaggaggaggtggacaagctgcatcagcgctatgtcaaggaactgtgtgaactcttcgaaacccacaagctcaagtacaatgtccctgtggaccaacatttggagttctgctga

SEQ ID NO: 28 - DNA, 1820 bp, Bos taurus
gaggagccagcatggtggagtttgcacctttgtttgtgccactggagcgcagactgcagacctttgcagtcctgtactggatcttctgcttcatggtcttaccccctttatgccttgtggtcttcataggcctcctgttcacaagattctggctcttcaatatcctgtatgtgatctggttgtacttggaccaaaataggccacggcaggggggcagtcacaataagttcctaaagcgctgggtcctgtggaagtacatgaaggactatttccccatcacgctagtcaagaccactgagttggacccctcccggaactaccttgctgccttccaccctcatggactcctgtcagtcggagcttttaccaacatgtgcacagacagcacgggcttctcctcacttttccctggcatccgcccacatctgacaacgataaacatatatttcaggatcccactcttcagagattacatcatgcaaggggggctggtctcatcagacaaggagagtattgcttacattctgagcaggaaaggaggcggcaacctagtggccatcactgttgggggcatcagggaggcactgaaaaccaggcctggagccaacaagctggtgctgcggaaccgcaagggcttcatcaggctcgccctgatgcatggagcagttctggtgccgatcttctcctttggggacaatgaattatatgctaagacttctcctggcttttggtggaaatggttcagagatcaactgtacaagaagacacgtcttgccatcccgttcttctatggccgtggagtcttccagtacagttttggttttatgccctaccgccgacccatcaccaccgtggtggggaagcccatcgaggtgccgaagataccacatccctcccaagaggaggtggacaggctgcaccagcattacctgaaggagctgagcaacctcttcgaaacccacaagctcaagtacaacatccccaaagaccaacacttggagttctgctgagtacctccccagaggaggggcttgccccaaagggcagggctggcattaggaagggaggtgctgtgatcccagaaggtttcctggaggtatctgttgaacacatctccagagccttcactgactcctgcatctccaccccatgccaggccccaggtcacatctggctcatagaagaggagaccagactctggcatcaatgatttgctctcctccactaactcctctgtaacgggccctctctttggttctgcccacctgagaaatgggagagatactgggagaaaatgctgtctgtgtgtccgtcctctgtggtcctgtcactcaataagcaggacaaacagcagctccagtgagcaggtttcccttcctctgccttgagtgacagctggaagcagcccccagctgcagccctttctcctacaagctcccttatcctacatcctgcctgtcccatcttctccctccctgagccggagaggagggggagggcacaacctcctggctcatcctggcacctctgagtttctgagccccatatggcagccagaagggcctggaggtggggaagacctgagctctgtcactggctaaatgactgtacaccaacctcttcaacctccctctgagtctcagttttcccaaggactaaaatgacctctgacctcggctctaatcacacataggctgaaagctgcttatggtaactcctactctatcctttgtaattcagccctgaccttgggctccatatatgtcaattcatcacatgaaagattcgattttaaaaaaaaaaaaaaaaaaaaaaaaaaa

SEQ ID NO: 29 - DNA, 1774 bp, Rattus norvegicus
gtgtgtggagcctcctgagccagctcagcatggtggaattcgcccccctgttggtaccatgggagcgcaggctacagaccttcgcggtccttcagtgggtcttctccttcctggccttggcccagctctgtatcttcatcttcatcggcctcctattcacgaggttctggctcttctcagtcctatatgccacctggtggtacctggactgggacaggccgaggcagggaggccggcccatccaattcttcagacgcatggccatatggaagtacatgaaggatttcttccctgtctctttggtcaagacagctgagctggacccttcccggaactacatcgcaggctttcacccccatggagtcctggcggccggagcctttcttaacctgtgcactgaaagcacaggctttacctcgctcttcccaggcattcgctcctatctgatgatgctgactgtgtggttccgggcccccatcttccgagattacatcatgtctggggggctggtctcgtcagaaaaggtgagtgctgatcacattctgagcagaaagggcggcgggaacttgctagccatcatcgttgggggcgcacaggaagcactggatgccaggcccggagcctacaggctgctgctgaagaatcgcaagggcttcatcaggctcgccctgacacatggggcagctcttgtgccgatcttctcctttggggagaacaacctgtttaaccaagttgagaacacccctggcacctggctgcgctggatccagaactggctgcagaagatcatgggcatctcccttccgctcttccatggcagaggtgtcttccagtacagctttggcctcgtgcccttccgccagcccatcaccaccgtagtggggaagcccatcgaggtgcagatgataccacatccctcggaggaggaggtgaaccggcttcaccagctctatatcaaggagctatgcaagctctttgaggagcacaaactcaagttcaacgtccctgaggaccagcatctggagttctgctaagtgtctccagccggaagacagctgcatctgagcgcctgcaggagtgctgggatgagagggatttccacagccaccaggaactcctaggagcccagccacagctggcaagatggaggcagttcctaaccctgggattcgtccctgcagccaaagctctgagctctccctgtccttggtctgcacatctgtagaatgggggggaaagcaggcagagagcaattcctgaggtctctctccacagttgtaatgtcattcaaacatgaccaaaggacagccatggagaaagagaacaaaattgttctttacctacccttgagggacagtgcaagaggagccagcaccccaggcctctctgtacatgccccctggatgcctcttcttaccctctgagctggagaggggaagccatatatgccctggcacccactctatgtttcttccagattctgagtcctctgagctatgacatgaaggagcccagagacagttaaggaggacagagctcactgactatgaccgaggttagatctccttcccatgtcctgagcctcggtttcctcagccttaatgacctgggagccacacctctcacatcacagaggctcccccagggagcctcttactcatgctttctagtgaactctagcctctgtcttggcacaaaagggcagtgctgtacatgttgcttcaataaataaaaggagtctgtcgtaaaaaaaaaaaaaaaaaaaaaaaaaaaa

SEQ ID NO: 30 - DNA, 1056 bp, Gallus gallus
atggagcgtgcctataaaatctgtgatgacaccacgtccaaaagactgaaaaacctcttctgggctgtgcagaacgggtccccccaggtgagccgttcctctcccaccaccctcaccgctcaccgcctggcttttctcccagcacagtgctgcaccgctgccttcatcggcctcctcttcacccgcttctggctgctcagtgtcctctatgccgcctggtggttcgtggacagggaagcaccgctcaggggtgggcgacggatccacatggtgcggaacagcgcagtctggagacacatgagggacttcttccccgtcacgctggtgaaaacagcagagttggaccccaggcagaactacttggtgggatttcacccccacggggtcctggcagtgggagccttcatcaattttggaacagaggcgacaggcttttccacgatcttcccaggcatcaccccacacctgatgatgctctccttatggtttcgtgtccccttcttaagggactacctgatgagcggaggccttgtgtcctctgataaggagagtgcgtaccatgtgctgcagaggccagagggggggaacctgttggccatcatcgttggtggggctcaggaggctctggatgcccggccaggatcctgcaccttgctgctgaagaataggaagggatttgtccgcgtggccatcgagcagggcaccccactggtccctgccttttcctttggggagaatgagctcttcgaccaggtgagcaaccccaagggctcgtggctgcggtggatccagcaccggctccagcagatcatgggcatctccctacccctcttccacgcaagaggtatcttccagtacagcttcgggctggtgccctaccgccggcctatcaacaccgtgattgggaagccaattcccgtgctgaagaagcacaagccaacggaggaagaggttgatcgagtccataagaaatacttagaagagctgagcaagctctttgaggagcacaaagctaaatacaacgtcccagaagacagtcacctcgaatttatatag

SEQ ID NO: 31 - DNA, 1287 bp, Danio rerio
gtgtttggttcagaatgacccagtaaacttgttcatttgtggagcctgtgggaataagtaaacaaatcatacctggatctttgagttctccagagctggattttactcgccctgctgtattgtcctgttcttcatcctgctcttcacccgtttctggctcatcagtgtgctttatgccacctggtggtacatcgactgggacacaccttcacgaggagggagaatagtgccatatctctgcaaactgcgtgtgtgggagtacatgagagattatttccccatcaggctgataaagacggctgacttggacactaggaagaactatgtgatgggttttcatcctcatggtattctcgtggctggtgcttttacaaatttctgcacggaggcgactggatttagcaaactcttccctgggataaagagcaaccttcttatgctgcctctctggttcagagcccccttcttcagagattacatcatgtcagcagggctggttccatcagacaaggagagtgccagttatctgctccggaggaagggcggagggaatgcggtggtcattgcagtcggtggagctcctgaagctttggatgcacatcctggtgactacaccgttcacctggccaataagaaaggctttattaagcttgcaatagagcacggtgcagatttggttcctatatattcgtttggagagaacgaggtgtttgaccaggtgcagaatcctcgtggcacatggctgcgatacattcaagagcgtctgcagcgcatcatgggtgtttctcttcctctctttcatgcgcgaggagttttccagtacaccttcggcctgatgccttacagaaagcccatcaacactgttgtgggaaggccaattccagtggagaaaaatgagaaaccaacagcagaagaattggacgtctatcatcagcgctatatggatgaactggcacggctgttcgaggaccacaagggaaattatggagtacctgaagacactcatctggtgttccagtgagatgatcacttatgttgacgatgagtttgtgtgtttgtaccttgtatttcttacattgtaggaaccaaatgtcttcacatatatagacataccactacatttgaccttgtggggacatttgtttggttctaatgttcaaaatggctcatgaatcatgctgaatttaatatttagaaaatgtaaaaatgccgattgttttctgtgagggttgggtttaggggtagaaaaaaaaccaaaaaaaaaaaaaaaaaaaaaaaaaaaaaaaa

SEQ ID NO: 32 - DNA, 1268 bp, Drosophila melanogaster
ccgagagccgataaggataagtataagtctagtacagggcaatttgaccatcgctggcttccatatcattcagtcgtgggagaaccgccgaaagagcagctggtggagtttttttgggcatttttgtaacacagcagacatgaaaatcgagtgggcaccactgcgggttcctctggaacgccgactgcagatactggtcacggcctttttcacctccatgctgctgatactattgtcagtttccttccttttggtagctggatcactgatctacggaggtcttttggtgcgtagtctgatggtaacttacttggcctacgtctttgtgcaccacaagaaaacccaatccgttgtggatggcaatggctggatgataacacgcaccaaccttttgcatcgccactatcgtgattactttcccgtggagctggtgaaaacagccgaactgccagctactaagaactacatcttggccagctttccccacggaattctgggcacaggcattggcattaacatgggcttggaaatctccaagtggctggagctattcccccaagtgcgtcccaaactgggcactctggatcagcatttccatgttccgttcatgcgtgaggtcctccgctgctggggtctggtgtcagtgtccaaagaggcgctgatccgtatgctcagcaagtcaaatgatcccaagcacaaggataatcgggatggtttcacctccaatgcggtggccattctggttggcggtgcccaggaagccatggactctcatcctgggcagtacattttaaccttgaagaataggaaaggcttcgtgcgaatggccattagaacgggctcatcgattgttccttcattttcctttggagaggtggacattttcgatcaggtggcaaatccccccaactcgctgctccgacggtttcaggactttgtcaagaagctcaccggagtctctccgctgattcctgtgggccgcggattcttcaactacacctttggcttcctcccattccgacgacgcattgtccaagttgttggtgctcccatcgatgttgttaagaacgagcacccagactcggagtatgtggataaagtgcatggacaggtcattgagtcgctggagaagttattcgatcagtacaaagacaagtacttggagaattcgaagagtgccactctagttgtacactagttttaaatcatgttgatacaaaatattcctatgtattgaaatagaaacgagctttttaattgaatttaaa

SEQ ID NO: 33 - DNA, 1269 bp, Drosophila melanogaster
agttaaatgttgtacgctcgcatcgtcggttctgctgctcaaacgcgataacgatccattactcgccggaggaccgtgctaccaagtagttcaactttccgagttcgagagctctgacatcatgaaaatcgagtgggctcccaaaggagttcccatggaacggcgtcgccagacgtttgccatggccttcctaatcctatcctttatgatactctcctttggatcctatttcttcgttgctgccgtgctgttctatggaagccttttgtggcgcaccattatggtcatctatttggtctacgtctacgcgaatcacaagagaacccactccattatggatggcaatggctggaaaattaaccgcaacaattggctgtttcggcattatcgggactactttcccgtacagctggtcaagaccgcagagctgccgccgaataagaactacattttggccagttttccgcacggaattttggggactggcatttccattaatatgggtctagacatctccaagtggctgcaactgttcccacaggtgaggcccaaggtggccactttggatcaaaacttcctgacgcccatcgtgcgtggtctcctgagatcttggggcctggtgtcggtttccaaggaggccttagtatatctgctaaccaaatcaaacgatcccaagcacaaggacaatcgtgatgggttcacctccaacgcggtggctattctggtgggtggtgcccaggaggcactagactcgcaccctggcaaatatatattgacactgaagaaccgcaagggattcgttaaaatggccattaggacagggtcttcgattgttcccacgttttcctttggcgaggtggacattctggatcaggttgccaatccaccgaactctcgggttcgtcgctttcaagactttgtaaagaggataacggggatatctccgctgattcccgttggccggggcatcttcaactactcctttggctttctgcccaaccgtcgacgcattgtccaagttgttggcgctcccatcgacgtggttcagagcgatcaaccagacgcagcctatgtggataagatacacaaacaggttattgacgacctggagaagatgttcgccaagtacaaggatcagtacataccgaactccaagcaggacaagctgattatacactagtcgagaagttattgtctaaacaatgtgatcaaatgagtgctttataagcatttaatataaaaattacgaattttatcaggcaaataaaa

SEQ ID NO: 34 - DNA, 1139 bp, Drosophila melanogaster
atgacaatcgaatgggctcctctccgggttccgctggaacggcggcttcagaccctggttacgtcattcttcacctataccttctttacgctgcccatctcgtcctgcctcgcagtagctatcctgctgtactacggcgaaatgtttgtgcgtagtctgcttcttatctattttgtgaaaatttatttggattataaaagaaattacggcattatggaaggtaatggttggttattctaccgcagcaattggagatatcgaaactacttccccgtcgaacttgtaaaaaccgccgagctgcctcccaacaggaactatatcgtagcaagctttccacacggaatacttggtactggaacttgcattaacatgagcctggacatcgacaattggctatccctttacccgcacgttcgacccaagatcgccaccctggatcatcacttcaagacgcctttcctgcgtgacatattgcgctggtggggcatggtatcggtttccaaggaatccctgtcctatttactcagcaagtcaaatgatccaatgcacaaggataatcgggatggtttcacatccaatgcggtggccgtacttgttggtggcgccaaggaagccatggattcgcatccgggacagtacattttgaccctcaaggatagaaagggtttcgtcaaaatggctgttcgaaccggatcgtcgattgtgccctcgttgtcctttggcgaggtggacatatttgatcaggtggctaatcctccggactcctcgctccgtcgcttccagaatgtggtcaagaaattcacaggcatttcaccgctccttcccaagggtcgcggtatcttcaactacaactatggcattctcccacatcgacgacgtattgtccaagttgttggttcccccatcgatgtggaaagatgcgagactcccgatcccgaatatgtggacaagatccatgggcaggtgatcgacgcgctggcgaggatgttcgatgaatacaaagagaagtacactccaaactcaaagcatatcaaacttataatacagtgactcagtagagtcccttagattgtgattttttatagaattaaggaaacttttgaaacgcaacacagttttagactaatttaaaaaaaaaa

SEQ ID NO: 35 - DNA, 1971 bp, Anopheles gambiae
cgcatgaggagaaaagttggccactcagttattatacgcgacaagctcccagtataagcgtcattgttagatcgcattctacaatgacaaacggacccgacatcattagtcatgtttggccggtggtcagaagaaagcacagagggtggaagaaaagctgattcattgggtgaggacgttagtctgcgggcgtgtttttatcgtctcagtttgcatcatgccccagtgaaagtgataccgacacgacatttggtgaagccattcggttcaagattaagggacaggctaaaccagtacaagtgagtattcgttgattcattcgtaaaccgaacgttgtttgctcagcaagaagcaatgactgataagtgataacgtaattgcatcatcggcatcaatgctgataagatctcgagctgcgggaaggaaaacgcatcaagtggtacatcgtttgtggtgtgatagattttgggagggcgagtcgtagtggtggaacatcccccggtaccggttctagacgcgctcaccaaaacctaagatgggtaaaatcgaatgggccccactgaatgtgccgatgaggcggcggatcgaaaccctgtccactgccctgtggatgtggctgatactgttcggcgagctgggcatgctgatatcgtacttcctgctgctgatctatggtaacttgtttattaaatcgctgtgcgtcatctacggatacttcatctacactgatcgaaaagtgactttgaacgggggccgtggacagggtgtaacatggtggcgagagctgttctggtggaagctctaccagagctacttcccggcgaagctgcacaaaacggttgatctcgaccctaaccggaactacctgtttgccgccttcccgcacggcgtgcttggcctcggtgccttcatcaactttgccaccaatgcgaccggctttcacgacaagtttcccaaaatccgttcccgcccggtgacgctaaacttccactttgtgataccgttcttccgcgagctgctgctcagctggggcctcgtgtcggccaacccgaacagcatcctgagcctgctgaaggcgccgaacaaaccggaccacccgctgaacgacgacggctacacggccaacgcggtcgtgatagtggtgggcggtgcggccgaatcgctgcactgccggccgaacaactacacgctggtgctgcgcaagcggaagggcttctgcaagctggcgatcaaggcgggcaccccgctggtgccggtgatgacgttcggcgaggtcgacctgttcgatcagccgccgaatccgcccggctcgcggttgcgccggttccaggagtttgtgaaaaacacgaccggcatcgcgccggccgccttcgtcgggcggggcttcttccagtacagctacgggttgatcccgcgccggaagccactgaacacagtcgtcggtgctccggtggaggtgacgcaaatagacaacccgacgcaggaacaggtggatgaggtgcacgagcggttctgccgcgcgctggacaatctgttcgaaacgaacaaatcgcgcttcattgccgactacaagaatgtgaagcttgtcatggagtaataggtaaaatgcagatacttcccgtacttcccgccatctttacacacaaacgatcggtgtatagcggtgggaaaacggggcaaaatcacgcacaagagacacagaaacacactatcatcacgatatcctacgcaacccgtggaaattgtgttataattcgcatcgtaaggattgagactgtaccaaaaaaaaaaaaaaaacgaacgatcaaaaccaactcttttcatacctaagatccaaccattgtgcggtgccaacaggtgatattgttatacagctctgcgagagggagtcaattactagctgcgtaagagaggacacactacattgggagtgtttagcatttaaattctcgtgtaagtgtaattgtgtaa

SEQ ID NO: 36 - DNA, 1612 bp, Anopheles gambiae
gtcacattctaaccttacgcccgtgctgaaccccaggggagaccagtgcgcgctccactgtgaactccctagtgtgtagtgtattcttttcctgttgttttagatgtattaagggcgagtcgtagtggtggaacatcccccggtaccggttctagacgcgctcaccaaaacctaagatgggtaaaatcgaatgggccccactgaatgtgccgatgaggcggcggatcgaaaccctgtccactgccctgtggatgtggctgatactgttcggcgagctgggcatgctgatatcgtacttcctgctgctgatctatggtaacttgtttattaaatcgctgtgcgtcatctacggatacttcatctacactgatcgaaaagtgactttgaacgggggccgtggacagggtgtaacatggtggcgagagctgttctggtggaagctctaccagagctacttcccggcgaagctgcacaaaacggttgatctcgaccctaaccggaactacctgtttgccgccttcccgcacggcgtgcttggcctcggtgccttcatcaactttgccaccaatgcgaccggctttcacgacaagtttcccaaaatccgttcccgcccggtgacgctaaacttccactttgtgataccgttcttccgcgagctgctgctcagctggggcctcgtgtcggccaacccgaacagcatcctgagcctgctgaaggcgccgaacaaaccggaccacccgctgaacgacgacggctacacggccaacgcggtcgtgatagtggtgggcggtgcggccgaatcgctgcactgccggccgaacaactacacgctggtgctgcgcaagcggaagggcttctgcaagctggcgatcaaggcgggcaccccgctggtgccggtgatgacgttcggcgaggtcgacctgttcgatcagccgccgaatccgcccggctcgcggttgcgccggttccaggagtttgtgaaaaacacgaccggcatcgcgccggccgccttcgtcgggcggggcttcttccagtacagctacgggttgatcccgcgccggaagccactgaacacagtcgtcggtgctccggtggaggtgacgcaaatagacaacccgacgcaggaacaggtggatgaggtgcacgagcggttctgccgcgcgctggacaatctgttcgaaacgaacaaatcgcgcttcattgccgactacaagaatgtgaagcttgtcatggagtaataggtaaaatgcagatacttcccgtacttcccgccatctttacacacaaacgatcggtgtatagcggtgggaaaacggggcaaaatcacgcacaagagacacagaaacacactatcatcacgatatcctacgcaacccgtggaaattgtgttataattcgcatcgtaaggattgagactgtaccaaaaaaaaaaaaaaaacgaacgatcaaaaccaactcttttcatacctaagatccaaccattgtgcggtgccaacaggtgatattgttatacagctctgcgagagggagtcaattactagctgcgtaagagaggacacactacattgggagtgtttagcatttaaattctcgtgtaagtgtaattgtgtaa

SEQ ID NO: 37 - DNA, 1017 bp, Tribolium castaneum
atgaagattttggggatcaagttcgcccctttgcacatccccctcgagcgccgcttgcaaacccttgccgccggatgctggttcacaaccctggcctttggtaccttcatcggtaccttcatctgggtgtacgtcttcttcacccgattctggtacctgtccgtcctttacgccaccataatatacctcgagaaaagcaagtgtgagaagggcggccgccccatcgaatggatcagacattggggatggtggtactacttgaaaaactacttcccctgtaagcttgactttgtcccgggcctaacctttgatccgaagaggaattatctatttgcctgttacccccatgggatcctcccggcgggccctttcaacaccattggtagcccttacagcgaatttagcaagttgtttccaaagtttcgggtgaggttggtgattctgcaccaacatttcttcattccgtttctgcgggagattgcttatgggacaggggggatttcggcctcggccaagtcgttgaatcatgttttggggagtccggaaggggggtatattgcggtgttgatgcccgggggcgcagttgaggcctataacagccggcctggacagtacagaatcatcctgaagaacaggaaaggcttcgtaaaactggccttgaggaatgggtcaccactagtaccagttatctcgttcggggagccggaattgtttgatcaagttgaagggaggactttgaggaagattcaggagtccatcaggaagtacctcgggctggcacctgtgattttctcagggagagggttcttccagtactcgtttggcgttattccacaaaggaggcctattacgaccgttgtcgggcacccgattgaagttaccaaaatcgaaaaaccaacaaacgaggaagtggacgaactacataaaaagtacatgcaagagctggagaacttgttcgaagagtacaaattcaaatatttggagaatccgaaggacatacacttggagtttgaataa

SEQ ID NO: 38 - DNA, 1420 bp, Homo sapiens
cactcacacacctacggacacacgctactctgggaggtgatttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacctccacccactgtggactccatgcctccaataaaaggtagttctgggcccagcgcagtgcctcgtgcctgtgatcccagcactttgggaggccagggtgggaggatcgtttgagcccaggagttgaagaccagcctgggcaacacagtgagacttcatttctacaaaaaaaaaaaaaaa

SEQ ID NO: 39 - DNA, 1934 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 40 - DNA, 2223 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagttcatgggcttctctccttgcatcttctggggtcgtggtctcttctcagccacctcctggggcctgctgccctttgctgtgcccatcaccactgtgggtgagtgcccacctccggggggacggccaccagcagctgcgtgggcatcagggatccctcgcccacctgtctccctctccctgcagtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 41 - DNA, 2137 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagttcatgggcttctctccttgcatcttctggggtcgtggtctcttctcagccacctcctggggcctgctgccctttgctgtgcccatcaccactgtggtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 42 - DNA, 1749 bp, Canis familiaris
atgacgttccctgaccccaagacgggacagtgctgcctctctccggtcctgtccgggcctgggggcggccgggtggccctgctggccctgggagggcccctggaagcgctggaagcaaaacccggcgcgctgttttgcggatccggaatcagaagagatttgtccagctggcaccgggacacggagcgagctcttccagccgttcgcgaaccctccggacccttgggcctccttctgcccttccgggcgcgcccatccacccggtccgggagtcccagcctctgccccctcggctcccctgcgcgcaccagctccgcagcgctcgggccagcgcgctccccgcgccggggcgggaaccccgcgctgctgcccacgcctgggcacaccggctcacctcttttgacactcccagtccctgactctgtcgagacggtcgcgcgtggcaatgaagaggccgggcggtgccggggatcccgttctgcgcgcatggcgcggctcacgcggctgttccgggagcgcaaggcgcgcgccggcctcccgggccacccgcacctccccgccgtgtccctgaggtgccgacactcccggggacctgcacacggagccggggcgcgcaccaggggcctgcccggccacgctgggccccggaggcgtggagcgtttggtcgctccagcaagaaagccttcactccgtgcccaaaccttcgtcgtttgcgctccaggccctggaaccccactggcggaggggagcgccccaccatgagaaccacgcagaaacagtggctagaagccttaagcgtctcctattacgtgttcactttcctcttcatgggccttttcttctcccttcttgtcctcttcctcctcttcacttcattctggtccatctctgttctctacttggtgtggctcttcctggactgggacacacccaaccaaggtgggaggtgctttgagtgcaacaggagctgtaccatttggaaacacttgaaggattattttcctattaagctggtgaagacagcagagcttccccctgaccggaactatgttgtgggttgtcacccacatgggatcatgtgcatgggaaccttctgcaatttcttcacggaggccaacaacttctccaagcagttcccggggattcagacatcacccgtaacactggcctttctcttgcacctcccagtctatcgtgactacctcatgtaccttggactgtgttctgtgaaccgccggagcctggactttattttgtccaagccccagcccgggcaggcggtagccatcgtagttgggggtgcccacgagtccctgtttgcgatcccagggatgcactgcctcgttctccggaaccgcaaaggcttcgtgcgcctggcactgaggcacggagcttccctggtacctgtgtactcctttggggagaatgatatcttcaattttaaggcttttcccacaaactcctggcagtatctgtgccagatcaccatcaagaagatcatgaaattttctccttgcatcttctggggccgcggactcttctcagctgactcctggggtttactgcccttcgccaagcctatcaccactgtggtgggccgccccatccctgtgccacagcgcctcaaccccactgaggaggaagttgaccactatcacatgctctacatggaggctctagagcaactgtttgaggaacacaaggaaagctgtggtgtcccagcctctactcacctcatctttaaatag

SEQ ID NO: 43 - DNA, 1221 bp, Bos taurus
atgataagtgagagcagactggagacctctggggctctgatgagagagtctccccacgcacacagccccctacaagcgatcctgggaggctcccaagcgcttggccactcagaccagaaagatttcctgcgctccaaccaaagccttcatcccatttttcctggttcggaagccctgctggctgaaggggagcacctgggagtctccaccaccccaccacccacccccagcatgaaaaccttaaagaaacagtggttagaagtactgagcacctaccaatatgtgctctgtttcctcttcctgggccctttcttttcccttgttggcttcttcctcctcttcacctcgctctggtatctctctgttctctacttggtatggttattcctggactgggacacaccccagcaaggtggaaggcgtaatcagtggttgaagaactgcactgtgtggaaacacctgagcgattatttccccattaagctggtgaaaacagtagagctgcccccagacaggaactacgtgctattgtcccacccacatgggatcatgggctttggaaccgtctgtaacttcagcacggagggcactggctgctcgcagctgttcccagggcttcggttctcactggccgtgttgaattgtctcttgtacgtgccaggctgtcgagagtacattatgtcctgtggaacatgttctgtgaaccgtcagagcctggattatgttctatctcaaccacagctcggcagggctgtggtcatcatggtcggaggggccaatgaggccctgcataccgtcccaggggagcactgcctcactctccggaatcgtaaaggcttcgtccgcctggcactgaggcacggtgcctccctggtgcccgtgtactcctttggggagaatgacgtcttcagagttaaggcttttgccccagactcctggcagcgtctgttccaggtcaccatcaagaggctcctgagcttctctccttgcatcttctggggccgtggtctcttctcagccaagtcctggggcctgatgcccctcgccagacccatcaccactgtggtgggccgccccatcccggtgccccagtgtccacagcccaccgaggagcaggtggaccactatcacaggctctacatgaaggctctggagcaactgtttgaggagcacaagaagagctgcggcctcccggcttctactcacctcaccttcatctag

SEQ ID NO: 44 - DNA, 1872 bp, Danio rerio
acacacagtcgctccaccctcatacagacgtcgcacgagcgaggagcatacattcactcaaactcaagggatatttaaaagatatttcccgacttaatgacattttctagctcaagcaggtattcgcggcgtcttctagtcacccagtcgtgacagcaaagactcgaattctttctctgtttacaaatgattcacgttaaagcaaagcgtcgtttacagggggttcagtcatgcggacgcggattcaaaagtggctggagataaacctcagatagccagtccagaaactacccacatacatttgcaatgacgcgataagacaacgaatcgttatctgtttgaccaattgaaccgatcaaagtgcgagccagacaaatacaagacttcggtcagtgaaggtgaggaagaggattcgtttgccacaggatcactaaacttggccactttaatgggaacagataacgtttcagaggtaaaggagaagggggacaggtcaccatggaaagatataatcgaggatataagtgttttgcaattggtgttgtcatttctttttttaggagtggcttgtctactattgatgatctacctgatgttcacctctctgtggattttccccactctgtacttcacctggcagatctatgattggcacacacctgagagaggtggcagaagaacaaagtttgtgagaggctgggaagtatggaaacacttgcgagactattttcctgtgaagctggtaaagactgctgaattaaatcccaataagaactatattatgggctgtcacccgcacggcatcatgtgttttggagccttctcctgcttcagcacagaccgcaatggatttgcggaaacctttcctggaatacggtccactcttgcaatcttagccggacttttccgccttcctctcttcagggaatacattttagctgcaggattgctgcctgtcagtaaggcaagtttggattatttgctgagccaaactggtgtgggtaacgctgtggtcatcatcattggtggagcagaggaatcactgacctcctctacaggagtaaacactgtggtcataaaacacaggaaaggctttgtacgactggctcttgaacacggggcagacctggttccagtgtactcttttggagagaacgagctgttcccgcaggtggttctgtctgagggcagtgtaggtcgacggctgcaggttctttttaagcagattatgggttttgctccatgcatcttcacaggaggccggtggcttcttctgccgtacaaacttccagtcaccactgtggtgggctgccccataaacgtccctctggtgaaaattccaactcaggaacaggtggatcattaccacggtttatacatggcatctctggctgatcttttccacaagcataagaccagctatggactggcagagacgcacgagctgcacttcatttagcagtgctggaaagcacaaagccatttaaaaagctgactgggatataatgtggggctgatataggaaaaggacaatgcacttatttctgtactgttccatgtgaatgttttaacttcttggttctctgaaatgattcacaaagcacaaaatgaaccaaatgaatacggagatgggcatttgtctgtaacaaaacactcatccttaagaaaggcaaaaggtttgcttacggttatctcagctttgttctgtaaatttgcactgaaatttttacaacatgttagtgtttattataaaggttatacaaagacttttgaagaaaatcatttttaaaaattggtttaatataaatgatttacatatgtattttgttatgtctattcatgtgaaagattataaaaccagcacatttttac

SEQ ID NO: 45 - protein, 335 aa, Mus musculus
MMVEFAPLNTPLARCLQTAAVLQWVLSFLLLVQVCIGIMVMLVLYNYWFLYIPYLVWFYYDWRTPEQGGRRWNWVQSWPVWKYFKEYFPICLVKTQDLDPGHNYIFGFHPHGIFVPGAFGNFCTKYSDFKKLFPGFTSYLHVAKIWFCFPLFREYLMSNGPVSVSKESLSHVLSKDGGGNVSIIVLGGAKEALEAHPGTFTLCIRQRKGFVKMALTHGASLVPVFSFGENDLYKQINNPKGSWLRTIQDAMYDSMGVALPLIYARGIFQHYFGIMPYRKLIYTVVGRPIPVQQILNPTSEQIEELHQTYLEELKKLFNEHKGKYGIPEHETLVFK

SEQ ID NO: 46 - protein, 334 aa, Homo sapiens
MKVEFAPLNIQLARRLQTVAVLQWVLSFLTGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGLVSVSKKSVSYMVSKEGGGNISVIVLGGAKESLDAHPGKFTLFIRQRKGFVKIALTHGASLVPVVSFGENELFKQTDNPEGSWIRTVQNKLQKIMGFALPLFHARGVFQYNFGLMTYRKAIHTVVGRPIPVRQTLNPTQEQIEELHQTYMEELRKLFEEHKGKYGIPEHETLVLK

SEQ ID NO: 47 - protein, 334 aa, Pan troglodytes
MKVEFAPLNIQPARRLQTVAVLQWVLSFLTGPMSIGITVMLIIHSYSFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVLSVGLVSVSKKSVSYMVSKEGGGNISVIVLGGAKESLDAHPGKFTLFIHQRKGFVKTALTHGASLVPVVSFGENELFKQTDNPEGSWIRTVQNKLQKIMGFALPLFHARGVFQYNFGLMPYRKAIHTVVGRPIPVRQTLNPTQEQIEELHQTYMEELRKLFEEHKGKYGIPEHETLVLK

SEQ ID NO: 48 - protein, 335 aa, Pan troglodytes
MKVEFAPLNIQPARRLQTVAVLQWVLKYLLLGPMSIGITVMLIIHSYSFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVLSVGLVSVSKKSVSYMVSKEGGGNISVIVLGGAKESLDAHPGKFTLFIHQRKGFVKTALTHGASLVPVVSFGENELFKQTDNPEGSWIRTVQNKLQKIMGFALPLFHARGVFQYNFGLMPYRKAIHTVVGRPIPVRQTLNPTQEQIEELHQTYMEELRKLFEEHKGKYGIPEHETLVLK

SEQ ID NO: 49 - protein, 335 aa, Canis familiaris
MKVEFAPLHIPLARRLQTAAVLQWVLSFLLLAQVCIGIIVVLIVHNYWFLYVPYLTWLCLDWRTPEQGGRRSNWVRSWTVWRYFKDYFPIHLIKTWDLDPSHNYIFGFHPHGVLVAGAFGNFCTNHSDFEELFPGFTAYLHVLPFWFRCPLFREYLMTSGSVSVSKKSVSYVLSKEGGGNISVIVLGGAEESLDAHPGKFTLFIRQRKGFVKVALTHGASLVPVFSFGENELFKQVNNPEGSWLRTVQEKLQKIMGFALPLFHARGIFQYNFGLMPYRKPIHTVVGRPIPVHRTPHPSPGQIEELHQTYMEELRKLFEAHKRKYGIPEHETLIFK

SEQ ID NO: 50 - protein, 335 aa, Bos taurus
MKVEFAPLNIPLARRLQTAAVLHWLLSFLLFAQVCLGIIVFLIIYNYWFLYLPYLTWLYFDWQTPEQGGRRSEWVRNWAIWRYFKDYFPIHLIKTWDLDPSHNYIFGFHPHGVLVVGAFGNFCTNYSAFKELFPGFTSYLHVLPYWFRCPLFREYLMSSGPVSVSKKSVCHVLSKEGGGNISVIVLGGAEESLDAHPGKFTLFIRQRKGFVKIALTHGAYLVPVFSFGENELFKQVSNPEGSWLRNVQEKLQKIMGFALPLFHARGIFQYNFGLIPYRKPIHTVVGRPIPVRQTLNPTSEQIEELHQTYMEELRKLFEEHKGKYGIPENETLIFR

SEQ ID NO: 51 - protein, 183 aa, Rattus norvegicus
MSKEGGGNISVIVIGGAKELLESFPGRYSLCLLQRKGFVKIALTHGAHLVPVFSFGENELYSQVDNPKGSWLRTAQDKVYNLTGLALPLFYARGIFQNSFGLMPYRKLIYTVAAVGTAARLTQKSNHQNDSSVSAEKGNSFICCQVGWCDRDRQPLAAPSLFRRLCTRPQSRLMSCIRRTWRS

SEQ ID NO: 52 - protein, 287 aa, Danio rerio
MLGALYAGWLYLDRDTPSCGGRRSQWVRSWRIWMHFRDYFPITLVKTVDLDPRHNYLLGFHPHGVLVAGGFGNFCTEASGFSQMFPGLTPYLLMLPFWFRVPFFREYIMCGGLVSSEKASASYLLGHPGGGQAAVIAVGGAPESLEARPGALTLQLLQRKGFIKLALKHGAWLVPVFSFGENELFDQMENPAGSALRRMQERLQRIMGVALPLFHARGVFQYSFGLLPYRKPIHTVVGRPIPVSQTPCPSKEDIDALHTLYMQGLTQVFEENKKHYGIADDKHLKFT

SEQ ID NO: 53 - protein, 349 aa, Caenorhabditis elegans
MLDRTESEDKMPHLLGVEWAPLNIPLARRLQTLGALHFFFITLFTPVLVLTVPFYMLYTVLWPLIFLYGLWMIYDWNSPKKGAYMSNWFQRQRIHSWYANYFPVKLHTTSDMPEEHNYLIGYHPHGIISMAAFINFATNGTGILDTLPRIRFHLCTLVGQFWTPWRREWGLLHGMIDCSRESIKHVLEHEKKGKAVVLVVGGAEEALDAHPGCHILTLKKRKGFVKIALQTGAQLVPCYSFGENDIFNQAENPKGSTIRQFQTIMKRVLGFSPPAFYGRGVFNYTFGLLPFRKPINTVLGAPISVTKTVNPTQEQIDTLHQTYMDRLHELFEEHKTKYDVSPTTQLVIN

SEQ ID NO: 54 - protein, 339 aa, Caenorhabditis elegans
MPHLLGVEWAPLNIPLARRLQTLGALHFFFITLFTPVLVLTVPFYMLYTVLWPLIFLYGLWMIYDWNSPKKGAYMSNWFQRQRIHSWYANYFPVKLHTTSDMPEEHNYLIGYHPHGIISMAAFINFATNGTGILDTLPRIRFHLCTLVGQFWTPWRREWGLLHGMIDCSRESIKHVLEHEKKGKAVVLVVGGAEEALDAHPGCHILTLKKRKGFVKIALQTGAQLVPCYSFGENDIFNQAENPKGSTIRQFQTIMKRVLGFSPPAFYGRGVFNYTFGLLPFRKPINTVLGAPISVTKTVNPTQEQIDTLHQTYMDRLHELFEEHKTKYDVSPTTQLVIN

SEQ ID NO: 55 - protein, 340 aa, Caenorhabditis elegans
MPQFLGIEWVDLFSSIQRKKTYLGVVYHFMLTYPLALFVTILPFFLLFTFQWHILALYACWYFYDMDSPRRGGYSSDWVRKWRVNDWFAQYFPINLHKTAELSTDKNYLVGIHPHGIISMAAWSNFATNGTGIYEKFPGIRWNLCTLALQFRMAIRRELLLLTGLIDCSRESIEYVLDKCGQKGRAVVLVIGGAEEALDAHPGYHTLTLASRKGFVREALITGAYLVPVYSFGENDVFEQMENPVGSRLRNFQEWCKSIFGISYPIFHGRGFFQLTFGYLPFRKPIDTVVGAPIPVEKVENPTKEQIDELHTIYCQKLTELFDEHKEKYGVEKDVPLVLR

SEQ ID NO: 56 - protein, 345 aa, Caenorhabditis elegans
MLNYQIHKKLTDIKWVNIFSPWDRQRAYFALVVWFGLIYPFCCLCQVAPFVLFFTGQWIILGLYAVWYLYDRESPRRGGYRDNWFRNLSLHKWFAEYFPVKLHKTAELDPNQNYLFGYHPHGILGVGAWSCFGFDACNVKQVFKGIRFNICTLPGNFTAMFRREILLSIGMIESSKESIEHVLNSEEKGRAVVIVVGGAAEALEAHPGKHTLTLANRKGFVREAVKTGAHLVPVYAFGENDIYKQIDNPEGSKLRKIQEWGKKKMGISLPLIYGRGYFQMALGLLPMSRAVNVVVGAPIQVEKELDPSKEVIDEIHGVYMEKLAELFEEHKAKFGVSKDTRLVFQ

SEQ ID NO: 57 - protein, 359 aa, Caenorhabditis elegans
MRLRLSSISGKAKLPDKEICSSVSRILAPLLVPWKRRLETLAVMGFIFMWVILPIMDLWVPFHVLFNTRWWFLVPLYAVWFYYDFDTPKKASRRWNWARRHVAWKYFASYFPLRLIKTADLPADRNYIIGSHPHGMFSVGGFTAMSTNATGFEDKFPGIKSHIMTLNGQFYFPFRREFGIMLGGIEVSKESLEYTLTKCGKGRACAIVIGGASEALEAHPNKNTLTLINRRGFCKYALKFGADLVPMYNFGENDLYEQYENPKGSRLREVQEKIKDMFGLCPPLLRGRSLFNQYLIGLLPFRKPVTTVMGRPIRVTQTDEPTVEQIDELHAKYCDALYNLFEEYKHLHSIPPDTHLIFQ

SEQ ID NO: 58 - protein, 412 aa, Kluyveromyces lactis
MGKEQIRKRQTKKVRKGSQPVANGKSSVVGVSKDGKPEFCAIDTPIERRLQTLSVAWYVECIPLMIIIMLFVWVNPLMWSFVIPYTIYYFIDRTASNGNAVKRHSKWFRSLKVWFYFRDYFPISMHKSTELEPTFTSIDSTELENDASEPGYLDSSQPVLPDKWWNPFREKDETVRPTGPRYIFGYHPHGIAAFGAFGAFATEACNWSKVFPGIPVCLLTLVNQFQIPVYRDYLLALGITSVARKNAMKVLEKNYSIAIVIGGASESLLTNLGSSDIILSKRKGFVKLALQTGNVSLVPVYGFGETDTYKILKLKNDSIIGRIQIWLKENYSFTVPLFFARGVFNYDFGLLPFRHPVNVVVGNPIHIKEKIDHPTIEEIDHYHSLYIEELKRLYDDNKAKFNYSEKTLNIVE

SEQ ID NO: 59 - protein, 461 aa, Ashbya gossypii
MQDSMDDSLREAEGRQDDSEVSSGTTLGSSTPEDSGVTAKLRKKYQMASALLRRELEELSVYDAKTAGVSGRSSGSGSGGLALLGGRFHVAPLRIPARRRLQTLVVAWHTSSFIYMTVLVLFLAANPLMWWFMVPYMVYYVWNRSPANGGVVRRYSPRLRSLALWRYYCEYYPISLHKSEDLAPTFVPDPRGAEPREWKLRLWLWPTRVELLNLTLQWTRARPQVATGPRYIFGYHPHGVGALGAFGAIATEGCNWSKVFAGIPACLCTLVNQFQIPIYRDYLLGLGCTSVARKNVLKVLEQNYSVCIVVGGAQEALLSRVGSTELVLNKRKGFIKLALETGNVNLVPIYAFGETDCFNVLDTGNESYLRKFQLWIKKTYGFTIPFFFARGVFNYDFGFLPFRNPINVVVGKPVYVDKRRTNPTMEEIDHYHDLYVQELRNVFDKNKHKFGYAGKELKIVE

SEQ ID NO: 60 - protein, 550 aa, Magnaporthe oryzae
MATVDDTQNHVQLNAESSLNEFPYQASADKEEYPSLPSAPLPDVDGSSQNGHTAANADLPPSESTEQPWNKVASGDFIHETKMPSEDRDNLARPGSLPTPEPSRRGSNTLVGSPRQGDGLQMLMDEFADDESSDTSWDIHETIRSRTQALAEKDHQGIFSNQRRGNQADAPDTVTSANAWLPAGFEDDLDEVTGADDEFEPTRGSRWRVRLAPLDTPFHRRMQTLVVLLHVLGMGITFSFFCFLCTLPLFWPIIIAYLVFIRLSRAGSDGKTNRRIEWLRRARIWKYFADYFPVKLHKTADLPPTRKYIFAIHPHGIISHGAFASFATEALGFSEKFPGITNSVCTLHGNFKTPFYREYLMAMGLISVSKESIINTLMTGGINGEGMGRAVSIIVGGAREALEACPKTMRLILKRRGFCRMALRTGADLVPVLCFGENDLYQQWGPQDHPRFRRLQMKALAYLGFAVPVLRGRGVFNYDFGVLPQRRPINVVVGEPIKVEQFRGSGNIEPRVEELWKLYCQKLQELYDQNKHVYFKDRQEDMRFVDSEEL

SEQ ID NO: 61 - protein, 334 aa, Ciona intestinalis
MWEFAPLRIPMIRRLQTLAVSHFVFCFLALAATCTLLTIYITLFTSYWPITTAYLVFLFLDRNTPESGGRRSEWVRNWSLWKWMSDYFPCTLHKTVDLDPKRNYIFGIHPHGVLCIGSFTHFSTNGSGFSHVFPGFTSYLTMLPFWFKMPFFRDYVMSGGLTPATRKAIKHTITRPGGGHICCIIPGGAPESLNARPGDVVLLLKQRLGFLKLAITNGVPLVPVFSFGDHALWEQKPNPPGSLIRRFQDSSQKWMQVALPVFHARGIFQYNFGLIPYRRSVHTVVGEPIEVPQNSNPTSEDLMSLQEDYINRLRAIFDEHKSKYLPEDCKLIIN

SEQ ID NO: 62 - protein, 334 aa, Mus musculus
MVEFAPLLVPWERRLQTFAVLQWVFSFLALAQLCIVIFVGLLFTRFWLFSVLYATWWYLDWDKPRQGGRPIQFFRRLAIWKYMKDYFPVSLVKTAELDPSRNYIAGFHPHGVLAAGAFLNLCTESTGFTSLFPGIRSYLMMLTVWFRAPFFRDYIMSGGLVSSEKVSADHILSRKGGGNLLAIIVGGAQEALDARPGAYRLLLKNRKGFIRLALMHGAALVPIFSFGENNLFNQVENTPGTWLRWIQNRLQKIMGISLPLFHGRGVFQYSFGLMPFRQPITTIVGKPIEVQMTPQPSREEVDRLHQRYIKELCKLFEEHKLKFNVPEDQHLEFC

SEQ ID NO: 63 - protein, 334 aa, Homo sapiens
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 64 - protein, 334 aa, Pan troglodytes [sequence omitted]

SEQ ID NO: 65 - protein, 334 aa, Canis familiaris
MVKFAPLFVPWERRLQTFMVLQWVFSFLALAQICTVVFVGLLFTRFWVVSVLYAAWWYRDRDTPRQGGRPVQALRRCFLWKYMRDYFPVTLVKTAELDPSRNYLAGFHPHGVLAAGAFVNLCTESTGFPLLFPGIRSHLMMLTLWFRVPFFRDYIMSGGLVTSDKESAAHILSRKEGGNLLAIIVGGAQEALNARPGDSTLLLRNRKGFIRLALMHGAALVPIFSFGENELFDQVENSPGSWLRRIQNRLQKIMGISLPLFHGRGVFQYSFGFIPYRQPITTVVGKPIEVQKTLCPSKEEVDKLHQRYVKELCELFETHKLKYNVPVDQHLEFC

SEQ ID NO: 66 - protein, 332 aa, Bos taurus
MVEFAPLFVPLERRLQTFAVLYWIFCFMVLPPLCLVVFIGLLFTRFWLFNILYVIWLYLDQNRPRQGGSHNKFLKRWVLWKYMKDYFPITLVKTTELDPSRNYLAAFHPHGLLSVGAFTNMCTDSTGFSSLFPGIRPHLTTINIYFRIPLFRDYIMQGGLVSSDKESIAYILSRKGGGNLVAITVGGIREALKTRPGANKLVLRNRKGFIRLALMHGAVLVPIFSFGDNELYAKTSPGFWWKWFRDQLYKKTRLAIPFFYGRGVFQYSFGFMPYRRPITTVVGKPIEVPKIPHPSQEEVDRLHQHYLKELSNLFETHKLKYNIPKDQHLEFC

SEQ ID NO: 67 - protein, 334 aa, Rattus norvegicus
MVEFAPLLVPWERRLQTFAVLQWVFSFLALAQLCIFIFIGLLFTRFWLFSVLYATWWYLDWDRPRQGGRPIQFFRRMAIWKYMKDFFPVSLVKTAELDPSRNYIAGFHPHGVLAAGAFLNLCTESTGFTSLFPGIRSYLMMLTVWFRAPIFRDYIMSGGLVSSEKVSADHILSRKGGGNLLAIIVGGAQEALDARPGAYRLLLKNRKGFIRLALTHGAALVPIFSFGENNLFNQVENTPGTWLRWIQNWLQKIMGISLPLFHGRGVFQYSFGLVPFRQPITTVVGKPIEVQMIPHPSEEEVNRLHQLYIKELCKLFEEHKLKFNVPEDQHLEFC

SEQ ID NO: 68 - protein, 351 aa, Gallus gallus
MERAYKICDDTTSKRLKNLFWAVQNGSPQVSRSSPTTLTAHRLAFLPAQCCTAAFIGLLFTRFWLLSVLYAAWWFVDREAPLRGGRRIHMVRNSAVWRHMRDFFPVTLVKTAELDPRQNYLVGFHPHGVLAVGAFINFGTEATGFSTIFPGITPHLMMLSLWFRVPFLRDYLMSGGLVSSDKESAYHVLQRPEGGNLLAIIVGGAQEALDARPGSCTLLLKNRKGFVRVAIEQGTPLVPAFSFGENELFDQVSNPKGSWLRWIQHRLQQIMGISLPLFHARGIFQYSFGLVPYRRPINTVIGKPIPVLKKHKPTEEEVDRVHKKYLEELSKLFEEHKAKYNVPEDSHLEFI

SEQ ID NO: 69 - protein, 252 aa, Danio rerio
MRDYFPIRLIKTADLDTRKNYVMGFHPHGILVAGAFTNFCTEATGFSKLFPGIKSNLLMLPLWFRAPFFRDYIMSAGLVPSDKESASYLLRRKGGGNAVVIAVGGAPEALDAHPGDYTVHLANKKGFIKLAIEHGADLVPIYSFGENEVFDQVQNPRGTWLRYIQERLQRIMGVSLPLFHARGVFQYTFGLMPYRKPINTVVGRPIPVEKNEKPTAEELDVYHQRYMDELARLFEDHKGNYGVPEDTHLVFQ

SEQ ID NO: 70 - protein, 352 aa, Drosophila melanogaster
MKIEWAPLRVPLERRLQILVTAFFTSMLLILLSVSFLLVAGSLIYGGLLVRSLMVTYLAYVFVHHKKTQSVVDGNGWMITRTNLLHRHYRDYFPVELVKTAELPATKNYILASFPHGILGTGIGINMGLEISKWLELFPQVRPKLGTLDQHFHVPFMREVLRCWGLVSVSKEALIRMLSKSNDPKHKDNRDGFTSNAVAILVGGAQEAMDSHPGQYILTLKNRKGFVRMAIRTGSSIVPSFSFGEVDIFDQVANPPNSLLRRFQDFVKKLTGVSPLIPVGRGFFNYTFGFLPFRRRIVQVVGAPIDVVKNEHPDSEYVDKVHGQVIESLEKLFDQYKDKYLENSKSATLVVH

SEQ ID NO: 71 - protein, 352 aa, Drosophila melanogaster
MKIEWAPKGVPMERRRQTFAMAFLILSFMILSFGSYFFVAAVLFYGSLLWRTIMVIYLVYVYANHKRTHSIMDGNGWKINRNNWLFRHYRDYFPVQLVKTAELPPNKNYILASFPHGILGTGISINMGLDISKWLQLFPQVRPKVATLDQNFLTPIVRGLLRSWGLVSVSKEALVYLLTKSNDPKHKDNRDGFTSNAVAILVGGAQEALDSHPGKYILTLKNRKGFVKMAIRTGSSIVPTFSFGEVDILDQVANPPNSRVRRFQDFVKRITGISPLIPVGRGIFNYSFGFLPNRRRIVQVVGAPIDVVQSDQPDAAYVDKIHKQVIDDLEKMFAKYKDQYIPNSKQDKLIIH

SEQ ID NO: 72 - protein, 349 aa, Drosophila melanogaster
MTIEWAPLRVPLERRLQTLVTSFFTYTFFTLPISSCLAVAILLYYGEMFVRSLLLIYFVKIYLDYKRNYGIMEGNGWLFYRSNWRYRNYFPVELVKTAELPPNRNYIVASFPHGILGTGTCINMSLDIDNWLSLYPHVRPKIATLDHHFKTPFLRDILRWWGMVSVSKESLSYLLSKSNDPMHKDNRDGFTSNAVAVLVGGAKEAMDSHPGQYILTLKDRKGFVKMAVRTGSSIVPSLSFGEVDIFDQVANPPDSSLRRFQNVVKKFTGISPLLPKGRGIFNYNYGILPHRRRIVQVVGSPIDVERCETPDPEYVDKIHGQVIDALARMFDEYKEKYTPNSKHIKLIIQ

SEQ ID NO: 73 - protein, 353 aa, Ashbya gossypii
MGKIEWAPLNVPMRRRIETLSTALWMWLILFGELGMLISYFLLLIYGNLFIKSLCVIYGYFIYTDRKVTLNGGRGQGVTWWRELFWWKLYQSYFPAKLHKTVDLDPNRNYLFAAFPHGVLGLGAFINFATNATGFHDKFPKIRSRPVTLNFHFVIPFFRELLLSWGLVSANPNSILSLLKAPNKPDHPLNDDGYTANAVVIVVGGAAESLHCRPNNYTLVLRKRKGFCKLAIKAGTPLVPVMTFGEVDLFDQPPNPPGSRLRRFQEFVKNTTGIAPAAFVGRGFFQYSYGLIPRRKPLNTVVGAPVEVTQIDNPTQEQVDEVHERFCRALDNLFETNKSRFIADYKNVKLVME

SEQ ID NO: 74 - protein, 353 aa, Drosophila melanogaster; identical to SEQ ID NO: 73

SEQ ID NO: 75 - protein, 338 aa, Tribolium castaneum
MKILGIKFAPLHIPLERRLQTLAAGCWFTTLAFGTFIGTFIWVYVFFTRFWYLSVLYATIIYLEKSKCEKGGRPIEWIRHWGWWYYLKNYFPCKLDFVPGLTFDPKRNYLFACYPHGILPAGPFNTIGSPYSEFSKLFPKFRVRLVILHQHFFIPFLREIAYGTGGISASAKSLNHVLGSPEGGYIAVLMPGGAVEAYNSRPGQYRIILKNRKGFVKLALRNGSPLVPVISFGEPELFDQVEGRTLRKIQESIRKYLGLAPVIFSGRGFFQYSFGVIPQRRPITTVVGHPIEVTKIEKPTNEEVDELHKKYMQELENLFEEYKFKYLENPKDIHLEFE

SEQ ID NO: 76 - protein, 341 aa, Homo sapiens
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVVGRPIPVPQRLHPTEEEVNHYHALYMTALEQLFEEHKESCGVPASTCLTFI

SEQ ID NO: 77 - protein, 281 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGGPPHPCPPAPPPHRGGSQSLSRPLHDGPAAALRGAQGKLWGPRFHLPHLHLGLAAAFR

SEQ ID NO: 78 - protein, 344 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKFMGFSPCIFWGRGLFSATSWGLLPFAVPITTVGECPPPGGRPPAAAWASGIPRPPVSLSLQWAAPSLSPSASTPPRRKSITITPST

SEQ ID NO: 79 - protein, 341 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKFMGFSPCIFWGRGLFSATSWGLLPFAVPITTVVGRPIPVPQRLHPTEEEVNHYHALYMMALQQLFEEHKESCGVPASTCLTFI

SEQ ID NO: 80 - protein, 582 aa, Canis familiaris
MTFPDPKTGQCCLSPVLSGPGGGRVALLALGGPLEALEAKPGALFCGSGIRRDLSSWHRDTERALPAVREPSGPLGLLLPFRARPSTRSGSPSLCPLGSPARTSSAALGPARSPRRGGNPALLPTPGHTGSPLLTLPVPDSVETVARGNEEAGRCRGSRSARMARLTRLFRERKARAGLPGHPHLPAVSLRCRHSRGPAHGAGARTRGLPGHAGPRRRGAFGRSSKKAFTPCPNLRRLRSRPWNPTGGGERPTMRTTQKQWLEALSVSYYVFTFLFMGLFFSLLVLFLLFTSFWSISVLYLVWLFLDWDTPNQGGRCFECNRSCTIWKHLKDYFPIKLVKTAELPPDRNYVVGCHPHGIMCMGTFCNFFTEANNFSKQFPGIQTSPVTLAFLLHLPVYRDYLMYLGLCSVNRRSLDFILSKPQPGQAVAIVVGGAHESLFAIPGMHCLVLRNRKGFVRLALRHGASLVPVYSFGENDIFNFKAFPTNSWQYLCQITIKKIMKFSPCIFWGRGLFSADSWGLLPFAKPITTVVGRPIPVPQRLNPTEEEVDHYHMLYMEALEQLFEEHKESCGVPASTHLIFK

SEQ ID NO: 81 - protein, 406 aa, Bos taurus
MISESRLETSGALMRESPHAHSPLQAILGGSQALGHSDQKDFLRSNQSLHPIFPGSEALLAEGEHLGVSTTPPPTPSMKTLKKQWLEVLSTYQYVLCFLFLGPFFSLVGFFLLFTSLWYLSVLYLVWLFLDWDTPQQGGRRNQWLKNCTVWKHLSDYFPIKLVKTVELPPDRNYVLLSHPHGIMGFGTVCNFSTEGTGCSQLFPGLRFSLAVLNCLLYVPGCREYIMSCGTCSVNRQSLDYVLSQPQLGRAVVIMVGGANEALHTVPGEHCLTLRNRKGFVRLALRHGASLVPVYSFGENDVFRVKAFAPDSWQRLFQVTIKRLLSFSPCIFWGRGLFSAKSWGLMPLARPITTVVGRPIPVPQCPQPTEEQVDHYHRLYMKALEQLFEEHKKSCGLPASTHLTFI

SEQ ID NO: 82 - protein, 336 aa, Danio rerio
MGTDNVSEVKEKGDRSPWKDIIEDISVLQLVLSFLFLGVACLLLMIYLMFTSLWIFPTLYFTWQIYDWHTPERGGRRTKFVRGWEVWKHLRDYFPVKLVKTAELNPNKNYIMGCHPHGIMCFGAFSCFSTDRNGFAETFPGIRSTLAILAGLFRLPLFREYILAAGLLPVSKASLDYLLSQTGVGNAVVIIIGGAEESLTSSTGVNTVVIKHRKGFVRLALEHGADLVPVYSFGENELFPQVVLSEGSVGRRLQVLFKQIMGFAPCIFTGGRWLLLPYKLPVTTVVGCPINVPLVKIPTQEQVDHYHGLYMASLADLFHKHKTSYGLAETHELHFI

SEQ ID NO: 83 - protein, 520 aa, Arabidopsis thaliana
MAILDSAGVTTVTENGGGEFVDLDRLRRRKSRSDSSNGLLLSGSDNNSPSDDVGAPADVRDRIDSVVNDDAQGTANLAGDNNGGGDNNGGGRGGGEGRGNADATFTYRPSVPAHRRARESPLSSDAIFKQSHAGLFNLCVVVLIAVNSRLIIENLMKYGWLIRTDFWFSSRSLRDWPLFMCCISLSIFPLAAFTVEKLVLQKYISEPVVIFLHIIITMTEVLYPVYVTLRCDSAFLSGVTLMLLTCIVWLKLVSYAHTSYDIRSLANAADKANPEVSYYVSLKSLAYFMVAPTLCYQPSYPRSACIRKGWVARQFAKLVIFTGFMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHIYFPCLRSKIPKTLAIIIAFLVSAVFHELCIAVPCRLFKLWAFLGIMFQVPLVFITNYLQERFGSTVGNMIFWFIFCIFGQPMCVLLYYHDLMNRKGSMS

SEQ ID NO: 84 - DNA, 1856 bp, Arabidopsis thaliana
aaggaccttccctctctttctttccaaatctctctttatctctctttctctgtttactaaatcgccagtattcgccgcaagaaagatgtctccggcgaagaagagccgaagttttcctccgataagcgagtgtaaaagcagagagtatgattcgatcgctgcggatctcgacgggactctgcttctgtcaagaagctctttcccttacttcatgctggtggccattgaagcaggtagtctcttccgtggattgatccttcttctttctcttcccatcgtcatcatcgcttatctcttcgtctccgaatctctcggaatccaaatccttatcttcatctccttcgccggtatcaagatcaagaacatcgaactcgtctctcgcgccgttcttacacggttttacgcggcggatgtgaggaaagatagttttgaggtgtttgataaatgtaagaagaggaaagtagtggtgactgcgaatccgatagtgatggttgagccattcgtcaaagactatttgggaggagataaagttttgggaacagagattgaagttaaccccaaaacgatgaaagctactggttttgtgaaaaagcctggtgttcttgttggtgatctcaagagattagccatcttgaaagagttcggcgatgactcaccggatcttggcctcggtgaccgcacctccgatcacgatttcatgtccatttgcaaggaaggttacatggtgcatgagaccaaatcagccacaacagtccctatagagagtctcaagaaccgcataatcttccatgatggccgtcttgtccaacgtccgaccccattaaacgccttaatcatttacctttggcttcctttcggcttcatgctctctgtcttccgcgtctacttcaacctccctttacccgaacgcttcgtccgctacacttacgagatcctcggcattcacctcacaatccgtggccaccgtcctccacctccttcccccggaaaacctggaaacctctacgttctcaaccaccgcaccgcccttgaccccattatcatcgccattgctctcggccgtaagatcacatgtgtcacttatagtgtctctcgcctctccctgatgctctcacccattcctgctgttgctctgacccgagaccgtgtcgctgacgcagcccgcatgaggcaactcctcgagaaaggtgatttggtgatctgtcctgaaggcacaacgtgtagagaaccatatctactaaggttcagtgctctatttgcagagctgagcgaccggatcgtgcctgtggccatgaactgcaagcaagggatgttcaacgggacgacagttagaggtgtgaaattctgggatccgtacttcttcttcatgaacccccgacctagctacgaggccactttcttggaccgtttgcccgaagaaatgacggtaaacggtggtggcaagactccttttgaggtggctaattacgttcagaaggtgatcggtggagttttggggttcgaatgtactgaacttacaaggaaggataagtatctgttgcttggaggcaacgacggaaaggttgagtctatcaataagaccaagtccatggagtaataatccagctagtctggttgctgctattttgcttgggagtgaagttaggtctttcgggttttcccaattacttttttttttgttttttttcatgtattgttcgaggaaaatgttttgttgaatatgcactggataatgaaactacatttgaatcaaagtacgtacatgtagtgtaccatttccccttgccttaactatgaatgatttgtaaactcaccttgtattataagatatcatagagaaaaacacattctcgact

SEQ ID NO: 85 - DNA, 1845 bp, Arabidopsis thaliana
atatccattctcaccttccaaatctccccactctctctctctctctctctctctctctctctctctctctctctatctctctctatctctctctatcttctcttttctcctctctccaacttcttcactaatgggagctcaggagaaacggcgccgtttcgagcagatatcaaagtgcgatgttaaggaccggtccaaccataccgtggccgctgatctagacggaacactactaatctctcgtagcgccttcccttactatttcctcgtagccctcgaggcagggagcttgctccgagcgttgatcctacttgtgtccgtaccattcgtttatcttacgtacttgaccatctccgagactttagccatcaacgtatttgtcttcatcacgttcgcgggtctcaagatccgagacgttgagctagtggtccgttccgtcctcccgaggttctatgcggaggacgtgaggcccgatacctggcgtatcttcaacacgttcgggaaacggtacataataactgcgagccctcgaattatggtcgagccattcgtgaaaacattcctaggagttgataaagttcttggaacagagctagaggtctccaaatcgggtcgggcaaccgggttcaccagaaaaccaggtattctcgtcggtcagtacaaacgtgacgtcgttttgagagagtttggtggcctagcgtctgatttacctgatttggggctcggcgatagcaagacggaccacgacttcatgtccatctgcaaggaaggttacatggtgccacgtacgaaatgcgaaccattaccaagaaacaaactcttaagccccataatattccacgagggcagattagtccaacgcccaacgccgttagttgctctgttaactttcctctggcttcccgtcggtttcgtcctctctatcatccgcgtctacacgaatattccgttaccggaacgtatcgcccgttacaactacaagcttactggcatcaagctagtcgtcaacggccaccctcctccgccgccaaaacctggccagccaggccatcttttggtctgcaaccaccgcaccgttctcgatcctgtggtcacagctgtcgcactcggccggaaaatcagctgcgtcacttacagcatcagcaagttctctgagctaatctcaccaatcaaagccgttgcgttgactcgtcaacgtgagaaagacgcagcgaacatcaagcgtcttttggaggaaggcgatctcgtgatatgtcccgagggaaccacgtgccgtgagcctttccttctccggtttagtgctcttttcgctgagctcacggaccggatcgttcccgtggcgatcaacacaaagcagagcatgttcaatggtaccaccacacgtggatacaagcttcttgatccttactttgcgttcatgaacccgaggccgacgtatgagatcacgttcctcaaacagattccagctgagctgacgtgtaaaggaggcaaatctccgatagaggttgcgaattacatacagagggttttgggaggaaccttaggttttgagtgcaccaatttcacaagaaaggataagtacgcaatgcttgctggtactgacggtagggttccggtgaagaaggagaagacgtgattattgatcggaggatggagaaaacaaagaaataatacaaagattggaatctttttcatttggatggttaattatcaatacttaaggggcaaagaattgataagtttgtttttgttgttacctttatcttctctgcttcggtgaatgtttcttcaagttttacatttagtacaataacggtttaagaaaagaaagaaaaaagtatcggt

SEQ ID NO: 86 - DNA, 1216 bp, Arabidopsis thaliana
tcacttcttggtgttgttgatagactccaccttgccgtcattacctccaagcaaaagatatttatccttgcgagtaagttcggtgcattcgaagcccaaaaccgcgccgataactttctggacgtaattagccacctctataggagtcttgccaccaccgttgacagtcatttcttcaggcaaacgatccaagaaagtggcttcatagcttggtcttgggttcatgaagaagaagtaagggtcccaaaacttcacacccctaactgtggtcccgttgaacattccttgtttacagttcatcgctactggcacaatccggtcgcttagctctgcgaatagagcgctaaatctcagtagatactcttctctacacgtcgtgccttccggacatatcaccaagtcgcctgttatacaccaaaaacatatcattagctcaacaactccattgatttttaatttctcaactaaagattaatgtgaatgtaagtcaatattcaaaagaagtaaacaatattattttatgttcatttatataaatttggttagaagatgcgttaattaggtaccaaagtaaacatcaaagaccataccaaagtaatatttactatattgagatttgcatgggctactatatatgtattcatcgaaaaataaaaagaaagaaatagaaactcctattgaaccccctggacagtgaaacttgttataggtatgctctagtaatatatgatgagaagatgtgtaaagtacctttctcgagaagttttctcatgttggcagcatcggtggcacggtcacgggtgagggcaacagcaggaataggagaaagcataagggagagacgagagacactgtaagtgacgcaacagatcttacgtccaagagcaatagcaacgatgatgggatcaagcgcggtacggtggttaaggacatagaggttgccaagagttccaggggaaggaggtggaggacgatgaccacgaatggttaagtggatcccgagcatctcgtaagtgtaacggacaaatctttcaggtaaagggaggttgaagtagacgcgaatgatggagaggatgaaaccaaaaggaagccataggtatgtgataatggcgtttaacggagttggacgttgcgctaaacgcccatcatggaagactatgcggttctttaagcgttcttttggaatcgttgtggctgacttggtcgcatgaaccat

SEQ ID NO: 87 - DNA, 1736 bp, Arabidopsis thaliana
atctctctttctctgtttactaaatcgccagtattcgccgcaagaaagatgtctccggcgaagaagagccgaagttttcctccgataagcgagtgtaaaagcagagagtatgattcgatcgctgcggatctcgacgggactctgcttctgtcaagaagctctttcccttacttcatgctggtggccattgaagcaggtagtctcttccgtggattgatccttcttctttctcttcccatcgtcatcatcgcttatctcttcgtctccgaatctctcggaatccaaatccttatcttcatctccttcgccggtatcaagatcaagaacatcgaactcgtctctcgcgccgttcttacacggttttacgcggcggatgtgaggaaagatagttttgaggtgtttgataaatgtaagaagaggaaagtagtggtgactgcgaatccgatagtgatggttgagccattcgtcaaagactatttgggaggagataaagttttgggaacagagattgaagttaaccccaaaacgatgaaagctactggttttgtgaaaaagcctggtgttcttgttggtgatctcaagagattagccatcttgaaagagttcggcgatgactcaccggatcttggcctcggtgaccgcacctccgatcacgatttcaagtccatttgcaaggaaggttacatggtgcatgagaccaaatcagccacaacagtccctatagagagtctcaagaaccgcataatcttccatgatggccgtcttgtccaacgtccgaccccattaaacgccttaatcatttacctttggcttcctttcggcttcatgctctctgtcttccgcgtctacttcaacctccctttacccgaacgcttcgtccgctacacttacgagatcctcggcattcacctcacaatccgtggccaccgtcctccacctccttcccccggaaaacctggaaacctctacgttctcaaccaccgcaccgcccttgaccccattatcatcgccattgctctcggccgtaagatcacatgtgtcacttatagtgtctctcgcctctccctgatgctctcacccattcctgctgttgctctgacccgagaccgtgtcgctgacgcagcccgcatgaggcaactcctcgagaaaggtgatttggtgatctgtcctgaaggcacaacgtgtagagaaccatatctactaaggttcagtgctctatttgcagagctgagcgaccggatcgtgcctgtggccatgaactgcaagcaagggatgttcaacgggacgacagttagaggtgtgaaattctgggatccgtacttcttcttcatgaacccccgacctagctacgaggccactttcttggaccgtttgcccgaagaaatgacggtaaacggtggtggcaagactccttttgaggtggctaattacgttcagaaggtgatcggtggagttttggggttcgaatgtactgaacttacaaggaaggataagtatctgttgcttggaggcaacgacggaaaggttgagtctatcaataagaccaagtccatggagtaataatccagctagtctggttgctgctattttgcttgggagtgaagttaggtctttcgggttttcccaattacttttttttttgttttttttcatgtattgttcgaggaaaatgttttgttgaatatgcactggataatgaaactacatttgaatcaaagtacgtacatgtagtgtac

SEQ ID NO: 88 - DNA, 1817 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgccgccaccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctccgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaacttttttgaccatgttagccgagttggcatcatacaggtctggctagcctaacagcgttgtcctgccacaccaccctaggtaacgtagcagaacaaaactgtcacgcttgacacgacagtgtcattttgccatgttagacacaggctggcgtgattaaaatgttcaactttctaaaataagctatagaatagtttgtttttaatataaaaaaagaaaaattcaaaagttaatataaattccatgcaccggcgagttagctggtgagctagctgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcgcggtgagcacgcaccggcgcccgcacgccgagaacacgcgccacgactccgggtggatgtcggagcagtagaacttgggcagcacggcgcgcgccaccgcctcaacgtcggcgaccctcgcgccggccatggacgcgaagatgagcacctggatgccggccgactcggacaccaggtagtagagcacgccggcgagcggcgccagcaggatcagcgccagcagccggaggacgccccccgtctcgaacgccat

SEQ ID NO: 89 - DNA, 1924 bp, Picea sitchensis
ccccccggtacgttttgtttgagaaggaatatggcgaagggccagagtggcctcgactgtcaagggctctttgatgtgattagcaaatgcagctccaagggccgagaaaatcagaccgtggctgcggatcttgatggcaccatgctcagatccaggagctcgttcccttatttcatgctcgtggccatggagggcgggagcctgttacgcggcatggtgctcctcgcctgcgctcccatggcctggtttctctacaacttcatctccgaagctgcggggattcagcttctcatctttatttccttcgctggactcaagatccgggatatcgagctcgtttcccgcgccgtgttgcccaagttctatgccgaggacgtgcacccggagtcatggagggtcttcagcgcctttgggaagcggtacatcgtgactgcgaatccaagaatcatggtggagcccttcgtgaagggctatttgggggctgacaaggttcttggaacggagctgcaggtttccaggagcgggcgggctaccgggttcgtgaagaagcctggtgtgctcgttggggatttgaagaaggcagctgtggaagcggaattcggtgataaattgcctgagcttggccttggggatcgagagacagatcatcctttcatgtccctctgcaaggaggggtacatggtgcccaagatgaaggtggacgaagtgcccacaaacaaactaatgagcccaatcgtcttccacgacgggcgtttggtgcagagaccgaaccccggggccgcccttctcacctttctatggctgcccataggcttctttttggctcagtttcgagtcttcggcaacattcccatcccagagaaatacgtgaaaatctcctacaagataatgggaatcaagctggtcgtcaagggaacgcctccgccggccccgaagaagaaaggcgagcggggcgtgctgttcgtatgcgatcacagaacgttgctggatcccgtgatcgtggccgtggccctgggaaggaaagttagcgccgtcacgtacagcatcagtcggttctcggagattatctcgcccattaaaaccgtccggctcactcgggaccgcgagagggacgccgctaacatcaagcgcctgctggaggagggcgacctggtgatctgcccggagggcaccacgtgcagggagcccttcctcctgaggttcagtgctctattcgcggagctcacggacaggatagtgcccgtggccatctgcaacaagatgagcatgttccacggaacaacggtgcgcgggtggaagggcttcgatccttttttctttttcatgaatccggtgcccacctacgaggtaacgttcttggatcagttgcctacggagctcacgtgcgccggaggcaaatctcccatcgaagtcgctaattacattcagagggtgctggcggccactcttggctacgagtgcaccaatttcaccaggaaggacaagtaccggatgctcgcaggcaacgatggcattgtttcccttaataagactgctactgcccgcagcaacaaccacaaacagaattgatccaccgaattccaccgaattccaggccgggtattcttaatcatgataaattttaataatctcttattaatctatgattccaattattacatactgcaaatttgaacgcgtagttaagcagaatcttcccacgaatgaatgtatacacctcataattggtatatctgtattgcaaattagatcagatcgtagttaaagaagaatcccactaatggttgcgccataattggcacatctggtcattatattgcaaattattccagtaatttgcctggactgtattatgctcaaggatcagaaataatataatgcccaaggatttttttgtccaaaaacaagaaaaaaaaaaaaaaaa

SEQ ID NO: 90 - DNA, 1765 bp, Zea mays
cgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggccaggccaggcgtgctcgtcggcgaccacaagaagaaggccgtcgtcaaggagctcggcgacgcgctgcccgacgtcggcatgggggatagggagaccgacttcgacttcatgtccatctgcaaggaggcctacctggtgacgtcaaggaagtacagcccggtgcccaggaaccagctgctgagcccgctgatcgtgcacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtcaagggcaccccgccgccgccgcccaagaagggccacccgggcgtcctcttcgtctgcaaccaccgcaccgtgctcgaccccgtcgaggtggccgtggcgctgcgccgcaaggtcagctgcgtcacctacagcatctccaagttctccgagctcatctcgcccatcaaggccgtcgcgctgtcgcgggagcgcgacaaggacgccgagaacatccgccgcctgctggaggagggcgacctggtcatctgccccgagggcaccacctgccgcgagcccttcctgctgcgcttcagcgcgctcttcgccgagctcaccgaccgcatcgtgcccgtggccatcaacaccaaggagaccatgttccacggctccaccgtgcgcggcttcaagctcatggatccctacttcttcttcatgaacccgcgcccgacgtacgagatcacgttcctcacccagctccccaaagacctcacgtgcagcggcggcaagtcgcccatcgaggtggccaactatatccagaagacgctcagcggacagcttggcttcgagtgcacgtccatcacgcgcaaggagaagtacggcatgctcgctggcaccgacggccgtgtcccgtccaagaacaaggagaaggagaaggagaaggataagaactaacggccaacgtcgctctcttgctgctgcccagcagactgccgtttaattactgctcaaatttattccaatttattgttccttgtcgacaagttggccagtgtgatgtgggccgtgtactagtacaagcttgatgatgattagtatatctacaattcttcctttccggaagaagggcggaagagttgtt

SEQ ID NO: 91 - DNA, 1778 bp, Arabidopsis thaliana
agagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaagaaaggttacatggttcatgcgaccaagtcagccacaacgattccaaaagaacgcttaaagaaccgcatagtcttccatgatgggcgtttagcgcaacgtccaactccgttaaacgccattatcacatacctatggcttccttttggtttcatcctctccatcattcgcgtctacttcaacctccctttacctgaaagatttgtccgttacacttacgagatgctcgggatccacttaaccattcgtggtcatcgtcctccacctccttcccctggaactcttggcaacctctatgtccttaaccaccgtaccgcgcttgatcccatcatcgttgctattgctcttggacgtaagatctgttgcgtcacttacagtgtctctcgtctctcccttatgctttctcctattcctgctgttgccctcacccgtgaccgtgccaccgatgctgccaacatgagaaaacttctcgagaaaggcgacttggtgatatgtccggaaggcacgacgtgtagagaagagtatctactgagatctagcgctctattcgcagagctaagcgaccggattgtgccagtagcgatgaactgtaaacaaggaatgttcaacgggaccacagttaggggtgtgaagttttgggacccttacttcttcttcatgaacccaagaccaagctatgaagccactttcttggatcgtttgcctgaagaaatgactgtcaacggtggtggcaagactcctatagaggtggctaattacgtccagaaagttatcggcgcggttttgggcttcgaatgcaccgaacttactcgcaaggataaatatcttttgcttggaggtaatgacggcaaggtggagtctatcaacaacaccaagaagtgaatatcttattcttgttataacttggcattgacttattgcaagtaaggttggatcatatacgaattttcatgtgtgtaattgcttgagctcttgtcatcattatggtacgttattgttatgtttattctattttgttcttaatgtcgaacgggtaactatatccttaaaaactattttgtgatcccgtttctatacggatgtgtatagagactttctatttaaagtgcaaaattttattggagaaaaaaaa

SEQ ID NO: 92 - DNA, 1832 bp, Oryza sativa
ggctagctgctccgtgtctccctcgttgcatggtaagctagcatgtcgccgttcaagccgatcgagcagtgctcgacggaggggcggtcgcagcagacggtggcctccgacctcgacggcacgctgctcctgtcccgcagcgccttcccgtactacctcctcgtcgcgctcgaggccggcggccccctccgcgcggtcgcgctgctcatgtccgtgcccttcgtctacctcacgtacgtcaccatctccgagtccctcgccgtgcgcgcgctgctgtacatcgccgtggcgggtctcgaggtgagggacgtcgagtcggtggcgcggtcggtgctgcccaggttctacgccggcgacgtccacccggaggggtggcgggtgttcagctcgttcggcaggaggtgcgtcgtgacggcgagccccagggtgatggtggagccgttcgcgagggcgttcctcggcgcggacagggtcatcggcacggagctggaggtcggcgaggacggcagggccaccggcttcgtcgccaagcccggcgtgctcatccgcgagcacaagaggaacgcggtggtgagggagttcggcgacgcgctgccggacgtcggcatgggggacagggagagcgacttcgacttcatggccatctgcaaggacgcgtacgtcgtgaccacctcgcggaagcaccggccggtgccggagagccagctgctgagaaccgtcgtcctccacgacggccgcctcgcccagcgcccgacggcgatcaacacgctgctcgtcttcctctggatgccggtcggcttcgcgctcgcgctcctccgcgcgtgcctcagcctgctcctccccgagcgcgtcctctcctacgcctacaagctcacgggcgtcgggctcgtggtgcgcggccgcccgccgccgccggacgggagccccggcgtgctcttcgtgtgcaaccaccgcaccgtgctcgaccaggtcgccgtcgccgccgcgctgggccgcaaggtgatctgcgtcacgtacagcgtccctcggaaaacgtacggcatgagctccaggctcccggaggcgctcacggcctcgccggtcaaggccgccgtcgcgctgtgcagggagcgcgacagggacgcggaccgtgtccggcggctgctggaggagggcgtcgacatcgtcgccttccccgagggcaccacctgccgaggggcgttcctgctgcggttcagctcgctgttcgccgagctcaccgaccgcatcgtgccggtggccatcgccaccagggagaccatgttccacggctccacggcgcgcgggtttaagggcatggacccttacttcttcttcatgaacccgcggccggcgtacgaggtcacgttcctgagccagctgccgagtgagctcacctccggcggcggcggcaagtcgccggtcgaggtggccaactacgtgcagaaggcgctcgccgggcagctggggtccgagcacatcggcatcacgcgcaaggagaagtagcgaatgcttgccggcaccgacggccgtgtggagtcgaatgaggactagaaccagaagccacacgcccactattattggttccaatatatatggccaggagcctcgtttcttcgttatttctgtcacataacaagcttcaagtgcttatacgagaactgaagatgcaacatagtagaactcatgttgttcgttgtggacttgtggtataacgactttgatcatttctttgtccttttatttttacaaaaatccaagaaatatagtcatataagtttcatactgatgtaaattcttttgctatataatagatttggctatgtttttttttc

SEQ ID NO: 93 - DNA, 2529 bp, Oryza sativa
tcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtccggcgtcagcgccgccgcgcggatcggcgagatcgccgtcgacagccggctaacgctgtacgtcacgcacgtcacggggcggcccagcgcgatggacacgatgatggggtccagcgcggtgcggtggttgcacaccaggagggagcccggcgtccccgggcgcggcggcggcggcggcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattagcaatttggcgccaaaacagagttagcacactaaggctgtgtttagtttcacatcaaaattgaaagtttggagaaattagaacggtgtaacagaaaagttggaagtttgtgtgtgtagaaaaattcgatgtgacagaaaagttaaaagtttaaagaaaaaagttaaatctaaacaaggcctaatttttacaaatatctggctttggagtatattcatatgtacattttgaacagttgtcttctttttttttgttaaataaaaacaaatattgatgatggactaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaaggcaattcaacaaaaagaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcgaagagcctctcgacgacctcgcgcttcttctcgccgacgaggacggccttgatgcggccggtgaaccgcttgccggaggcgaacgtctcgagctcggtgccggccacctcggcgccgaggaactcgcgcacgaactcccccaccatgacggccggcgacgcggtgaccacgacgcggcgctcggcgcagccgtggaacaccgcccacgtgtcggcgcgcaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacgaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccat

SEQ ID NO: 94 - DNA, 3320 bp, Oryza sativa
atgtcgccgttcaagccgatcaagcagtgctcgacggaggggcggtcgcagcagacggtggcctccgacctcgacggcacgctgctcctgtcccgcagcgccttcccgtactacctcctcgtcgcgctcgaggccggcggccccctccgcgcggtcgcgctgctcatgtccgtgcccttcgtctacctcacgtacgtcaccatctccgagtccctcgccgtgcgcgcgctgctgtacatcgccgtggcgggtctcgaggtgagggacgtcgagtcggtggcgcggtcggtgctgcccaggttctacgccggcgacgtccacccggaggggtggcgggtgttcagctcgttcggcaggaggtgcgtcgtgacggcgagccccagggtgatggtggagccgttcgcgagggcgttcctcggcgcggacagggtcatcggcacggagctggaggtcggcgaggacggcagggccaccggcttcgtcgccaagcccggcgtgctcatccgcgagcacaagaggaacgcggtggtgagggagttcggcgacgcgctgccggacgtcggcatgggggacagggagagcgacttcgacttcatggccatctgcaaggtacggacaaagaatattgcctattcccttaactacttactactacctaagttccaaaaatagtttgcttttacacatggacaactgcctgtctaaatgtagaaaaatgagttcttttttaaaaagtagaggtaggattgtactagcacacatgttcatattacgtgtgtcctagtatttggtacagtacatttataacggcaagtagcttatagtgcaacctgcaggcagcatatctgcatatggaattttgcgatgtggccgcccaattatgtacttagtattttttttaaaagagatgtacttagtatttcgcatacaattttgctatatatttgacgacaaattttaccacaaaaatttgacagatataattacagtacaatcgtagtgtaattacactgtaacttgcatgtaattacactgtaactatagtgtaacttgtatgtaattttcaaaaatatctccgtaacatgttatttcgataaaatgaggttgtgggaataaattctttcatatatgtgtgctatgatttgttttcttcctcaccaaaacaaatcttgtaatagatctaacgattcaaaattatgtgaaacttacatataagttacactgtagttacatgcaagttacagtgtaattacatataagttacagtgtaattacactaccactgtactataattacatctgtcaaatttttaggagaaaatttgtcgacaaatgtataggtggtccctttggcatatataagtaggttaattgcaacagtacaaacaatatattattaattccttgtactatgtaatacactgaatagtacaacgagtatgcattttgttcgttgccatttatgctgaggataattgtagtatggcattaatcgatctggaccaatctctccacgttaggtgtctgcattcaccggtgagatgatcagttgagaggtagttgtgccattgatatcgtccactgctttctcgttatcctttctctgtaggtgactctgaatctagctcttttcacggattgcatcaactgatatacgtcgtattcttcccaagttccctgcattcatgtcttatatatgctaactggacaattaatggctcatagcagggcagctgcctgtcagtgatcactccagcttggttgaatggttgagttagcctgtctgtttcatgatatctggtacaggtcccactcaataccgtttggtaggaatttatacttgtgatgtacttatgtcctcaaataagtccagggagaatatgaacgtaagcaaatttgtgattgctagacagacatgaaaaaccaaagtctagccatgcatgatctacagatttccttgtttcttccctccaactttgggaagtttgcactgaattaatacggttttgcttcatggtaggccattatatttgcaagtaatggtcctactagtataactggatcccaaatttccgatggagcatcacaatcacgatcatatgtcaagatcgatattatgctgtttggggcaaccgggcaaacatagcaccgggtaaactttggttcaacttacagttaatcagtagttaaccatgctgatatgataataagctgattagtccgtgtaagttaattaattaacctaccgggcatgcatgcaagttttggatggatttacataatggataagctggtactctgtttgtaaattctaatctactagcgtcctcaatttttttacttctccatttaaccagcgacccatgcattattctgtatttccgttgcatacttgcatttccatgcacgtgaactatgcatgacatgatgcatcttgatcaacgtggcacgtgcacgcatgcatgcaggacgcgtacgtcgtgaccacctcgcggaagcaccggccggtgccggagagccagctgctgagaaccgtcgtcctccacgacggccgcctcgcccagcgcccgacggcgatcaacacgctgctcgtcttcctctggatgccggtcggcttcgcgctcgcgctcctccgcgcgtgcctcagcctgctcctccccgagcgcgtcctctcctacgcctacaagctcacgggcgtcgggctcgtggtgcgcggccgcccgccgccgccggacgggagccccggcgtgctcttcgtgtgcaaccaccgcaccgtgctcgacccggtcgccgtcgccgccgcgctgggccgcaaggtgatctgcgtcacgtacagcgtccctcggaaaacgtacggcatgagctccaggctcccggaggcgctcacggcctcgccggtcaaggccgccgtcgcgctgtgcagggagcgcgacagggacgcggaccgtgtccggcggctgctggaggagggcgtcgacatcgtcgccttccccgagggcaccacctgccgaggggcgttcctgctgcggttcagctcgctgttcgccgagctcaccgaccgcatcgtgccggtggccatcgccaccagggagaccatgttccacggctccacggcgcgcgggtttaagggcatggacccttacttcttcttcatgaacccgcggccggcgtacgaggtcacgttcctgagccagctgccgagtgagctcacctccggcggcggcggcaagtcgccggtcgaggtggccaactacgtgcagaaggcgctcgccgggcagctggggtccgagcacatcggcatcacgcgcaaggagaagtag

SEQ ID NO: 95 - DNA, 2532 bp, Oryza sativa
tcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtcccgcgtcagcgccgccgcgcggatcggcgagatcgccgtcgacagcggggctaacgctgtacgtaacgcacgtaacggggcggccaacgccgatggacacgatgaaggggtccgaggcggttccgtggttgcacaacaggagggagccccggcgtcccccgggcgcagcgggcgccgccgcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattggcaatttggcgccaaaacagagttagcacactaaggctgtgtttagtttcacatcaaaattgaaagttcggagaaattggaacggtgtaacagaaaagttggaagtttgtgtatgtagaaaaattcgatgtgacagaaaagttaaaagtttaaagaaaaaagttaaatctaaacaaggcctaatttttacaaatatctggctttggagtatattcatatgtacattttgaacacttgtcttctttttttttcgttaaataaaaacaaatattgatgatgggctaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaggcaattcaacaaaaaaaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcaaaaagcctctcgacgacctcgcgcttcttctcgccgacgaggacggccttgatgcggccggtaaaccgcttgccggaggcaaacgtctcgagctcggtcccggccacctcggcgccgaggaactcgcgcacgaactcccccaccatgacggccggcaacgcggtgacaagaacgcggcgtttggcccagccgtggaaaacggcccaggtttcggcgcgaaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacaaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccat

SEQ ID NO: 96 - DNA, 2941 bp, Oryza sativa
ctagttcttttccttctccttgttcttggaagggacgcggccgtcggtcccggcgagtatgctgtacttctccttgcgcgttatggcggtgcactcgaagccgagctggccgctgagcgtcttctggatgtagttggccacctcgatgggcgacttgccgccgctgcaagtgagctccttgggcagctggttcaggaaggtgatctcgtacgtcggccgcgggttcatgaagaagaagtaggggtccatgagcttgaagccccgcacggtggagccgtggaacatgctctccttggtgttgatcgccaccggcacgatgcggtcggtgagctcggcgaagagcgcgctgaaccgcagcaggaacggctcgcggcaggtggtgccctcggggcagatcaccaggtcgccctcctccagcagccgccggatgttctcggcgtccttctcgcgctcccgcgacagcgcgacggccttgatcggcgagatgagctccgagaacttggagatgctgtatgtgacgcagctgaccttgcggcgcagcgccacggcgacctcaaccgggtcgagcacggtgcggtggttgcagacgaagaggacgccaggatgtcccttcttggggggaggcggcgggttgcccttcacgatgaggcggatgcccatgagcttgtaggtgtagaagacgatccgctccgggagtggcaggttgacgtacacgcggaggagcgcgagcacgaagccgaacggcatccacaggaaggtgacgagcgccaccagcggcgtcggacgctgcacgaggcggccgtcgtggaggatgagtgggctcagcagctggttcttgggcaccgcgctgtacttccttgatgtcacgaggtaggcctcctgcacagacacgcagcatgcatgttacaaacacttcactgatgcaaaaatcacagcatcaccatcacttcttattttatcgaatatataaatgcttgttcatctcgccatgtacgccaaacctacatcctaccacgattacaattcagtacagtccactactgatggttccacagatgacagatcttcacatgcttaatcaaaattatgttttttcggagttaaactgttggatttaagttgacgtgtatcagccaatcaataggcgagagtagaccagagcagtggtaaagaagtacagcgattactgtaccgcaacaactgcaagactggcgcccataaatgggtgatttcccctccacgagagaaattcgttatacccccggggcagtgacagaaagacgggtcccatggagaagggaaagaaggggcaagaccatgaatggcagtatttatttcagtggttctctgcattaccggctggaagaaaggaagaaagaaagggaaagcaagggcagccgtggatctggcaggcacagccagcaccagctctgatgtctcacgcgccagccggccgatctccttcaatgcggccgggacaaggcttgaattctcaccaaacaaccgtaaataatggagccagccagccggccggacggactgactcgaccgtggcatactggcatgagtgaatccacgcattcaatccggcgggccacgggcgagtaaaaaccatcggcttccttccatgctctggctctgcccgcctccagattccttttctgatcatttgctcgagctttcgagttgttaagcttcaggtgaggatctagtatgtgcgacgtagacgttttgtgagttctgataatgaccttgatccttattattagtttactgattaaggatgttggtggaacagagcgaccggtcagtgcaggaagcttaaactgggtttcgcataatgggctgagcaacatctacagatcagtgtcataaatggcctgacaatgactatacacccctgctgttcgcgtgctcgaccactgtggcatactctactctgatctgaaaccactctactctgatctgaaacctctgcatgtttgtacagattgcagaatttatagtaggcggtgttcatagcttcgtcatagcaaaaatcaattgtaactgatgtgctaattccacgttatgaaagtaatatgtgtgatggagactatacttaattccaattttcatgtttcttgtttggaatgcagtaattccgaaataaacagagcattctatacggaatttatgtacaagatggtctaaccagttcgtagttgccagtaattggcagtgctactactaattcgtcgcaggacttgatcactgcaattaacaatcaacacgacagtactattactatgagcaaaaaatgagtttgagggggcgtcaaatttaccttgcatatggacatgaagtcgaaatccgtctccctgtcgcccaagccgacgtcgggcaccgcgtcgcgtagctccttgacgacggcctgcctcttgtggtcgcccacgagcactccgggcttcaccatgaaccccgtggccttgccgttcttgccgacctccagctccgtcccgaccaccttgtcggcgccgaggaacgtcttggcgaagtgctccaccatgatcctggggctcgccgtgatgatgtaccgcttgccgaaggagttgaacaccctccagctctccgggtgcacgtcctccgcgtagaacttgggcagcaccgaccgcgccaccatctcgatgttcctcaccttgagccccgccacggagatgtacaccagcgtgctgatggccagcgactcggagaagaaaatgtaggtcacgtagacgaacggcacggacagcagcagcacgacggcgcggagcacgctgccggcctcgagcgcgacgaggaggtagtacgggaaggcgctccgcgacctgaccagcgtgccgtcgaagtcggcggccaccgtctgctccgacctcccatccgagctgcactcctccacgggcttgaacctccgcgacaccat

SEQ ID NO: 97 - DNA, 1930 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctctgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaactttttgacaatgttagccgagttggcatcatacaggtctggctagcctaacagcgttgtcctgccacaccactctaggtaacgtggcagaacaaaactgtcacgcttgacacgacagtgtcattttgccatgttagacacaggctggcgtaattaaaatgttcaactttctaaaataagctatagaatagtttgtttttaatataaaaaaagaaaaattcaaaagttaatataaattccatgcaccggcgagttagctggtgagctagttgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcgcggtgagcacgcaccggcgcccgcacgccgagaacacgcgccacgactccgggtggatgtcggagcagtagaacttgggcagcacggcgcgcgccaccgcctcaacgtcggcgaccctcgcgccggccatggacgcgaagatgagcacctggatgccggccgactcggacaccaggtagtagagcacgccggcgagcggcgccagcaggatcagcgccagcagccggaggacgccccccgtctcgaacgccatgtgcgcgaagtacgggaacgagctccggccgcacagcagcgtgccgtcgaggtcggcgacgatcgtgtcgccgccgcggtccttggacgaacacttctccaccgccgggaacggcgacgcgatcat

SEQ ID NO: 98 - DNA, 1960 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgccgccaccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctccgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaacttttttgaccatgttagccgagttggcatcatacaggtctggctagcctaacagcgttgtcctgccacaccaccctaggtaacgtagcagaacaaaactgtcacgcttgacacgacagtgtcattttgccatgttagacacaggctggcgtgattaaaatgttcaactttctaaaataagctatagaatagtttgtttttaatataaaaaaagaaaaattcaaaagttaatataaattccatgcaccggcgagttagctggtgagctagctgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcccggttaacaaggcaccggggcccggcaagccgaaaaaaagggccaagaatccgggtggatttcggagcattagaacttgggcagcacggcggggggcaccgccttaaagtcggggacccttgggccggccatggacgcgaagatgagcacctggatgccggccgaatcggaaaccaggtagtagagcaagccggcaaacggcgccagcaggatcagcgccagcagccggaggacgccccccgttttgaacgccatgtgcccgaagtacgggaacgagctccggccgcacagcagcgtgccgtcgaggtcggggacgatcgtgtcgccgccgcggtccttggacgaaaacttttccaccgccgggaacggcgacgcgatcatcggggggtcccccat

SEQ ID NO: 99 - DNA, 2311 bp, Selaginella moellendorffii
cttctgagccagcagtacaggggctggacggacttgaaaggcatttttctccagttccatttcaagtgagcacgttggaagcatttattctcctctgtggcgttctttctaactcggagttgtcccaggattcgacatggccgacttaaagtactcgcggctcgtccagttcggcctcgtggagaattgctcatctgaaggacgtggaatgcacacggttgcggcggatttggatggtacactgctcagacgcagaagctcgtttccatacttcctgctggtggctcttgaaggaggtagcctcttcagagcagttgttctcggacttttggcccctatcgcctggctgctttaccacttcgtctcggaggcagcagcaattcaacttctcatctatgtctctttttcggggcagaaggtgtccgagattgagaaggtggcaacggcggttctgccgaagttttactcccaggacgtccacagtgatgctttcagagttttctcgtcctgcgggaagaagtatgtcatcactgccaatcctcggatcatggtggagtatttctgcaaggccttccttggcgcggataaagttattgggactgaaatcgaagtggacgatgatggacgtgctacaggcttcgtcaagttcccaggtgtgctcgtgagtcaaaacaagaggaccgccttgaagctcgagttcgtggacggggagcttcccgagatcggactcggcgatcgagaaaccgacttcgccttcatgtcgctttgcaaggtaagcgcactctttccatatcatatacatattttgcatttcgagcatataatacttagctctgcctctttcgtgctgctttaactgttgaggggtgccaggatttgcgtgacactccagaatcagttacgagaagcgagttttctaactctggttgtaaccgtgtgatacaggaagcttacgttgttcccaagaggaaggttgacgcagtggacggcagcgctctggcgcagcgcgtgatcttccatgatggtaggctggtccagctcccaacgccgttcgtggcgctcgtcactttcctctggctccctatcggcttcgcgctcgcagtgctccggatcggcctcacctcccgttgcccccgaaagtacatgggaatgatctacgccatcctcggcgtccgccgcatcaccaaaggcaaagttcctcgcaaacaagacggcagggggctcctcttcgtgtgcaaccacaggactctggtggatcccatcttcctgggattggccgccgagagggacgtgaccgggctcacttacagcatcagccgggtgtccgaggtgctatcgcccatcgtcacggtccggctgacgagagacaaggagcgcgactttacgaagatgaagtcgctgctggagagggggagggacctgtgcctgtgtccggaggggacgacttgccgtgagccgttcttgctgcgattcagcgctctcttcacccagctcacgcacaggatcgtcccggcggccgtgaagacgaggcagagcatgtttaacgggacggcggtgcgggggtggaaggggatggatccattcttcttcttcatgaatccattcccgacgtacgaggtggagtttttggaggagctccccgcggagatgagcgtccaaaagggcggcaagagctcgttcgagacggccaatttcatccagaagatgctgggcgacaagctgggatacgagtgcacgaccttcacccgcaaggacaagtacctgatgctcaatggcagcgatggaacagtccccacgaaataggaaggggttggaaaagaaaacaagatggaaccgttggctggtgttgacttgaattgactagagttgacggttgaatactttttttttagtgttggctggctatctagcttgcactagtaaatgctaaaggttataggcaggcgattttaatccttccacatggctgggacaggaaatattgacttcgttcaattaaagggggaaaggttttagggcaggggtgttctagggcacggcagcgagctggcatcctcacaccggcagcatggcgtccggccggcggtacggcgctcgtgtctcgcattgccagagaaatgccactcccaacctccgccaccttttctctctccgccacctttgcgaactaaacaaatgtgttagaggaatcaaagatccaacacaccgaaacttcgtttttgttttcttcttgcctggtctttgtggaggcgaagaaaaaaaggaaacgagagagtctttgtacctttgggaatcaaactgctattgcgta

SEQ ID NO: 100 - DNA, 1989 bp, Selaginella moellendorffii
atgtcgctcgacggcggcaaggtcacggattctttcctggtagatgctccattcgagccggtggagcgatgctcgtcggcggggcgtgagaagcagacgtgcgtggcggatttcgacggtactctcatccgcggccggagctccttcccgtatttcatgctggtggcgctagagggaggaggcctcatccggagcgtgattcttggcctcttcgcgccgctcgcctggatcctctaccatttcgtctcggaatccgccggcatccgcctcctcatcttcatctccttcgccgggatgaaggccaagcagatcgagtcggtgtcgcgcgccgtgctgcccaaattctactcggaggacgtccacagcgaggcctaccgagtgttctcctcgtgcggcaagcgtgtggtggtgaccgccaatccccggatcatggtggagcacttcgccaagacgtgcctgggagcggacaaggtgctggggaccgagattgaggtgacgaggagtggctacgcgacgggattcctcaagcggccgggagttctcgtgggggtcaacaagcgcaaggctgtgaggcaggaattcggcgagcatttgccccatgtcggcattggcgatcgagccacggactttgctttcatggcgctctgcaaggtacttatctcgaatccaatcccgctctgcttggtgggtggagtggttgcttagttctcgatcgagctcgatgcattagatcaacactctgggcattgttttcgatcgatgatccatccctgcaattgctgcatgagtggatgattctcttgtttcttttgtttatcttttttccttgtctcatgcacacattcttacaagcgcactagcctaaaagaatctcttccaagcagcagtagaaacttctttccagtcaactaacgaacccatttgctgaccactatcaggaagcatacgtcgtcccaccctccaaagtggaggcgctgagccgagacaagctcgtcaagcccgttgtcttccacgacggccgcctcgtccagcggcccacgcccttgaccgccctcgtcaccttcctgtggctgcccgtcagcttcgtgctggcggtgttccggatcatggtcacggtaccctgcccgcgcgagtacgtgaccatcgtctacaagctcgtcggcatccggctcatcgtcaaggggccgatcccgccgcccaagaagcggggcgagtccggcgtgctcttcgtctccagccacaggacactgtgcgatccggtgttcgtgggggtcggggcccggcgggaggtgacggcgctcacctacagcatcagcagggtgtcggagttcctgtccccgatcaagacggtgggcctgtccagggaccgcgagagggacgcggccaagatcaaggcgctgctccagaagggggacctgtgcatctgtcccgagggaaccacctgccgcgagccattccttttgcgattcagcgcactgttcgcggagctgactgacaagatcgtgccggtggcgctgtgcacgaaggggagcactttccacgggacaacggtgcgcgggtggaaggggttggatccattcttcttcttcatgaatcccttcccgacgtacgaggtgacgtttctccagcagctgccgccggagctgacggtccagcagggcggcaagagcgcgatcgaggtggcgaatcacatccagcgggtgatcgcggacacgctgggattcgagtgcacgaacttcacccgcaaggacaagtacgggatgctggcggggaacgacggcaccgttccggagaggcggaggagcggcggcggaggtggcggcgccgccaaggatctcccgaaggacgagcaagcggcccaggggcaagaccaggtaaatggctgtagctaaaattgatttgcgaggatcgtggatccatgccatgggtcgggtctcacgcgctccttcgttataagtgaatgtaagctaagctactggcttgctctct

SEQ ID NO: 101 - DNA, 1554 bp, Selaginella moellendorffii
atggcagagtttccacccatcgaaaagtgtggcaccacaatcagccgcgagagcgaatcggtggcctccgatctggatggaacgctgctgcgcgggaggagttccttcccatactttttcctcaccactttcgagacgtcggggatcttgcgctcctggctgctcctcctcgtctcgcctctcgtctggcttctctatcacttcatctccgaggccgctggaatcaagctcctcatcttcgcttccctggcgggtgttccagtctctcagatcgaatgcatcgcccggagtgttcttccgcggttttatctccaggatctcaaccccgagacgtggaaggtcttctcgtcctttgggaagaagattgttgtcacagcgaatcccaggatcttggtggagtcgctctgcaaggaattcctaggtgctgacgaggtgattggaaccgagctggaggtggataaccgaggacgagcaaccggtttcgtcaagagccccggagttctcgttggagagaacaaagccaaggccttgctccaggcctgtgatcccgagcagctcccagacgttggacttggcgatcggcagaccgatttcccgttcatgaagctttgcaaggtacgtaacaaaagatcgtccctccttcccgcgacttagcagttctcacgctggcttctctcaatccaggaaggatacgtcgtccccccaagcaacaacgtggagccagttccaaagtcccagcttctgaagcccatcatctttcacgatggtcgtctcgtccagcttccgacgccactcgtggctctcgtcaccctcctctggatccccgtcggcttcgttctagcctgcctccgaatcgccgcaggctcgctgcttcccatgtcaatcgtgtaccatgccttctggctgctgggagtccgagtgaccgtgaaaggaacgccacctccgagagccaccaagaactcccgaggcgtcctcttcatctgctcgcaccggacgctgctagatccaatcttcctgtcgtgtgcgctgggccgaggcgtctccgccgtgacttactcggtgtcccgactgtccgagatcctcagcccgatcaaaacagtggctctctccaggaaccgctacaaggacgcggctcagatccgggagctcctgaaagaaggcgacctggtaatctgccccgagggaacgacgtgtcgggagccattcctgctgcgtttcagcgcactgttcgcggagctggccgacgatatcgtccccgtcgccatggacaaccggatgagcatgttccacggcaccgctgctcgtgcctggaaggggatggacccattctacttcttcatgaatcccagccccagctacgaggtaacgttcctccagcagctcccggaagagctcacttgcaagggcggcaagagctcccacgaagtcgcaaaccatatccagcgagctctggcgggagtgctagatttcgagtgtaccaatctgacgaggaaggacaagtacaaggcgctcgtcggcacggacggatcggtggagaccaagaagtcaacgtga

SEQ ID NO: 102 - DNA, 1554 bp, Selaginella moellendorffii
tcacgttgacttcttggactccaccgatccgtccgtgccgacgagcgccttgtacttgtccttcctcgtcagattggtacactcgaaatccagcactcccgccagagctcgctggatatggtttgcgacttcgtgggagctcttgccgcccttgcaagtgagctcttccgggagctgctggaggaacgttacctcgtagctggggctgggattcatgaagaagtagaatgggtccatccccttccaggcacgagcagcggtgccgtggaacatgctcatccggttgtccatggcgacggggacgatatcgtcggccagctccgcgaacagtgcgctgaaacgcagcaggaatggctcccggcacgtcgttccctcggggcagattaccaggtcgccttctttcaggagctcccggatctgagccgcgtccttgtcgcggttcctggagagagccactgttttgatcgggctgaggatctcggacagtcgggacaccgagtaagtcacggcggagacgcctcggcccagcgcacacgacaggaagattggatctagcagcgtccggtgcgagcagatgaagaggacgcctcgggagttcttggtggctctcggaggtggcgttcctttcacggtcactcggactcccagcagccagaaggcatggtacacgattgacatgggaagcagcgagcctgcggcgattcggaggcaggctagaacgaagccgacggggatccagaggagggtgacgagagccacgagtggcgtcggaagctggacgagacgaccatcgtgaaagatgatgggcttcagaagctgggactttggaactggctccacgttgttgcttggggggacgacgtatccttcctggattgagagaagccagcgtgagaattgctaagtcgcgggaaggagggacgatcttttgttacgtaccttgcaaagcttcatgaacgggaaatcggtctgccgatcgccaagtccaacgtctgggagctgctcgggatcacaggcctggagcaaggccttggctttgttctctccaactagaactccggggctcttgacgaaaccggttgctcgtcctcggctatccatctccagctcggttccaatcacctcgtcagcacctaggaattccttgcagagcgactccaccaagatcctgggattcgctgtgacaacaatcttcttcccaaaggacgagaagaccttccacgtctcggggttgagatcctggagataaaaccgcggaagaacactccgggcgatgcattcgatctgagagactggaacacccgccagggaagcgaagatgaggagcttgattccagcggcctcggagatgaagtgatagagaagccagacgagaggcgagacgaggaggagcagccaggagcgcaagatccccgacgtctcgaaagtggtgaggaaaaagtatgggaaggaactcctcccgcgcagcagcgttccatccagatcggaggccaccgattcgctctcgcggctgattgtgctgctacacttttcgatgggtggaaactctgccat

SEQ ID NO: 103 - DNA, 1757 bp, Selaginella moellendorffii
atggagcacccgtatgacgtgatcgacaattgctcggccgacaaccgcgagaagcagagcgtggtagccgacttggatggctcctgcgttcgcagccggagctccttcccttacttcatgctggtggctctggaaggaggcagcctcctgagaagcgtgctcctcatggtcatggcccccgtcgcgtggctgctctaccacttcgtctcggaggcagcaggcatcaaagtcctcatcttcttctcctgcgccggccagagagctcgggacatcgaagcggtggctcgcgcagttctccccaagttctactccgaggacgtccacagctccacctggagagtcttctcgtcgtgcggcaagcgctacattctcacggccagcccgagactgatggtggagcactttgccacgacatacctgggcgctgacaaggtgatagggacggagctgcaagtgacaaggagcgggtacgctacggggttcgtcaagagccccggcgttttggttggcgtcaacaagaggcgggcattgaaggccgtgtttggtgaggaggtgccagacctggggattggcgatcgcagctctgattatccgttcatggctttttgcaaggttggtacttctcgttctctctgagctctcttccttttcgcctgtagtcagcaggagcatatgcatatattgcagtgcatgctatgctagtctgtgatctttggagcaactcgtcgcctggctttctttttctttgattttgttgtatggttgttggtgtcaagtccgcgttgtcttcgttgtctccgtcgtcttctggctttatttcatccacggatgtggaacttccgagtctcaccagaactaataaagtcgcctctcttttttccttttcggctttgcaggaagcttacattgttcctagccagcctgccgacgccgttccagctcacaaactcgcgcgcaagattatctttcacgacggcaggctggtccagaggccgacgccgttcgtggcgctggtcacctttctgtggctacccgccggcttcctcctggccttcttccgcatcctggtggcgcttccatgcccggtcgagtacgtcccgctgctctacaaggtgatcggcgtccggctcatcgtcaagggcaaagtcccgccaccttccaagaacgggatcctcttcgtctgcacgcaccggacgctcatcgacccgataatggcctcggcggcctcggggagcgacgtgaccgcgctcacctacagcattagccgggtgtcggaggtgctctcgcccatcaagacggtgccgctgtcgcgggaccgggagagggacgcctcgaacatcaagcggctgctgctgaaggagaacttggcgatctgtcccgagggaacgacgtgccgggagcctttcctgctgcggttcagcgccctgttcgcggagctgtccgagaacatcgtcccggttgcgacgtcgaccaaaacgagcatcttccacgggacgacggtgcggggctggaaggggatggacccgttcttcttcttcatgaacccgttcccggtgtacgaggtgacgttcctcgagcggctgccgcacgatctgagcgtccaggggggcaagtcggcgatcgaggtggccaactacatccagagggtgctggcggacacgctgggattcgagtgcacgaactttacgcgcaaggataagtatgggatgctcatcggcagcgatggaacggtgcctgccaggaagaagtccttttga

SEQ ID NO: 104 - DNA, 2256 bp, Selaginella moellendorffii
agcttctgagccagcagtacaggggctggacggacttgaaaggcatttttctccagttccatttcaagtgagcacgttggaagcatttattctcctctgtggcgttctttctaactcggagttgtcccaggattcgacatggccgacttaaagtactcgcggctcttccggttcggcctcgtggagaattgctcatctgaaggacgtggaatgcacacagttgcggcggatttggatggtacactgctcagaggcagaagctcgtttccatacttcctgctggtggctcttgaaggaggtagcctcttcagagcagttgttctcggacttttggcccctatcgcctggctgctttaccacttcgtctcggaggcagcagcaattcaacttctcatctatgtctctttttcggggcagaaggtgtccgagattgagaaggtggcaacggcggttctgccgaagttttactcccaggacgtccacagtgatgctttcagagttttctcgtcctgcgggaagaagtatgtcatcactgccaatcctcggatcatggtggagtatttctgcaaggccttccttggcgcggacaaagttattgggacggaaatcgaagtggacgatgatggacgtgctacaggcttcgtcaagttcccaggtgtgctcgtgagtcaaaacaagaggaccgccttgaagctcgagttcgtggacggggagcttcccgagatcggactcggcgatcgagaaaccgacttcgccttcatgtcgctttgcaaggtaagcgcactctttccatatcatatacatattttgcatttcgagcatataatacttagctctgcctctttcgtgctgctttaactgttgaggggtgccaggatttgcgtgacactccagaatcagttacgagaagcgagttttctaactctggttgtaaccgtgtgatacaggaagcttacgttgttcccaagaggaaggttgacgcagtggacggcagcgctctggcgcagcgcgtgatcttccatgatggtaggctggtccagctcccaacgccgttcgtggcgctcgtcactttcctctggctccctatcggcttcgcgctcgcagtgctccggatcggcctcacctcccgttgcccccgaaagtacatgggaatgatctacgccatcctcggcgtccgccgcatcaccaaaggcaaagttcctcgcaaacaagacggcagggggctcctcttcgtgtgcaaccacaggactctggtggatcccatcttcgtgggattggccgccgagagggacgtgaccgggctcacttacagcatcagccgggtgtccgaggtgctatcgcccatcgtcacggtccggctgacgagagacaagcagcgcgactttacgaagatgaagtcgctgctggagagggggagggacctgtgcctgtgtccggaggggacgacttgccgggagcctttcttgctgcgattcagcgctctcttcaccgagctcacgcacaggatcgtcccggcggccgtgaagacgaggcagagcatgtttaacgggacggcggtgcgggggtggaaggggatggatccattcttcttcttcatgaatccattcccgacgtacgaggtggagtttttggaggagctccccgtggagatgagcgtccaaaagggcggcaagagctcgttcgagacggccaatttcatccagaagatgctgggcgacaagctgggatacgagtgcacgaccttcacccgcaaggacaagtacctgatgctcaatggcagcgatggaacagtccccacgaaataggaaggggttggaaaagaaaacaagatggaaccgttgactggtgttgacttgaattgactagagttgacggttgaattttttttttttggtgttggctggctatctagcttgcactagtaaatgctaaaggtttttcaagcaggcaggcgattttaatccttccacatgggtgggacagaaaatattgacttcgttcatttaaagggggcaaaggttttagggcacggaggggtggtctagggcacggaagcgagctggcatcctcacacaggcagcatggcgtccggccggcggtacggcgctcgtgtctcgcattgccagcgaaatgccactcccaacctccgccaccttttctctctcctggagttcttctgccacctttccgaactgaacaaatgtgttagaggaatcaaagatccaacacaccgaaacttcgtttttgttttcttct

SEQ ID NO: 105 - DNA, 2044 bp, Selaginella moellendorffii
atgtcgctcgacggcggcaaggtcacggattctttcctggtagatgctccattcgagccggtggagcgatgctcgtcggcggggcgtgagaagcagacgtgcgtggcggatttcgacggtactctcatccgcggccggagctccttcccgtatttcatgctggtggcgctagagggaggaggcctcatccggagcgtgattcttggcctcttcgcgccgctcgcctggatcctctaccatttcgtctcggaatccgccggcatccgcctcctcatcttcatctccttcgccgggatgaaggccaagcagatcgagtcggtgtcgcgcgccgtgctgcccaaattctactcggaggacgtccacagcgaggcctaccgagtgttctcctcgtgcggcaagcgtgtggtggtgaccgccaatccccggatcatggtggagcacttcgccaagacgtgcctgggggcggacaaggtgctggggaccgagattgaggtgacgaggagtggctacgcgacgggattcctcaagcggccgggagttctcgtgggggtcaacaagcgcaaggctgtgaggcaggaattcggcgagcatttgccccatgtcggcattggcgatcgagccacggactttgctttcatggcgctctgcaaggtacttatctcgaatccaatcccgctctgcttggtgggtggagtggttgcttagttctcgatcgagctcgatgcattagatcaacactctgggcattgttttcgatcgatgatccatccctgcaattgctgcatgagtggatgattctcttgtttcttttgtttatcttttttccttgtctcatgcacacattcttacaagcgcactagcactagcctaaaagaatctcttccaagcagcagtagaaacttctttccagtcaactaacgaacccatttgctgaccactatcaggaagcatacgtcgtcccaccctccaaagtggaggcgctgagccgagacaagctcgtcaagcccgtcgtcttccacgacggccgcctcgtccagcggcccacgcccttgaccgccctcgtcaccttcctgtggctgcccgtcagcttcgtgctggcggtcttccggatcatggtcacggtaccctgcccgcgcgagtacgtgaccatcgtctacaagctcgtcggcatccggctcatcgtcaaggggccgatcccgccgcccaagaagcggggcgagtccggcgtgctcttcgtctccagccacaggacactgtgcgatccggtgttcgtgggggtcggggcccggcgggaggtgacggcgctcacctacagcatcagcagggtgtcggagttcctgtccccgattaagacggtgggcctgtccagggaccgcgagagggacgcggccaagatcaaggcgctgctccagaagggggacctgtgcatctgtcccgagggaaccacctgccgcgagccattccttttgcgattcagcgcactgttcgcggagctgactgacaagatcgtgccggtggcgctgtgcacgaaggggagcactttccacgggacaacggtgcgcgggtggaaggggttggatccattcttcttcttcatgaatcccttcccgacgtacgaggtgacgttcctccagcagctcccgccggagttgacggtccagcagggcggcaagagcgcgatcgaggtggcgaatcacatccagcgggtgatcgcggacacgctgggattcgagtgcacgaacttcacccgcaaggacaagtacgggatgctggcggggaacgacggcaccgtgccggagaggcggaggagcggcggcggaggtggcggcgccgccaaggatctcccggaggacgagcaagcggcccaggggcaagaccaggtaaatggctgtagctaagattgatttgcgaggatcgtggatccatgccatgggtcgggtctcacgcgctccttcgttataagtgaatgtaagctaagctactggcttgctctctcgattgactcatcaggaatagatcgatcgggtggagagcatcgtgatcg

SEQ ID NO: 106 - DNA, 1715 bp, Oryza sativa
actcccacaccatcagcgagcacctagcggtcgcatcgctagctgccatctcctggtgagatccatcgagacgcccggcacgacgacgatggtgtcgcggaggttcaagcccgtggaggagtgcagctcggatgggaggtcggagcagacggtggccgccgacttcgacggcacgctggtcaggtcgcggagcgccttcccgtactacctcctcgtcgcgctcgaggccggcagcgtgctccgcgccgtcgtgctgctgctgtccgtgccgttcgtctacgtgacctacattttcttctccgagtcgctggccatcagcacgctggtgtacatctccgtggcggggctcaaggtgaggaacatcgagatggtggcgcggtcggtgctgcccaagttctacgcggaggacgtgcacccggagagctggagggtgttcaactccttcggcaagcggtacatcatcacggcgagccccaggatcatggtggagcacttcgccaagacgttcctcggcgccgacaaggtggtcgggacggagctggaggtcggcaagaacggcaaggccacggggttcatggtgaagcccggagtgctcgtgggcgaccacaagaggcaggccgtcgtcaaggagctacgcgacgcggtgcccgacgtcggcttgggcgacagggagacggatttcgacttcatgtccatatgcaaggaggcctacctcgtgacatcaaggaagtacagcgcggtgcccaagaaccagctgctgagcccactcatcctccacgacggccgcctcgtgcagcgtccgacgccgctggtggcgctcgtcaccttcctgtggatgccgttcggcttcgcgctcgcgctcctccgcgtgtacgtcaacctgccactcccggagcggatcgtcttctacacctacaagctcatgggcatccgcctcatcgtgaagggcaacccgccgcctccccccaagaagggacatcctggcgtcctcttcgtctgcaaccaccgcaccgtgctcgacccggttgaggtcgccgtggcgctgcgccgcaaggtcagctgcgtcacgtacagcatctccaagttctcggagctcatctcgccgatcaaggccgtcgcgctgtcgcgggagcgcgagaaggacgccgagaacatccggcggctgctggaggagggcgacctggtgatctgccccgagggcaccacctgccgcgagccgttcctgctgcggttcagcgcgctcttcgccgagctcaccgaccgcatcgtgccggtggcgatcaacaccaaggagagcatgttccacggctccaccgtgcggggcttcaagctcatggacccctacttcttcttcatgaacccgcggccgacgtacgagatcaccttcctgaaccagctgcccaaggagctcacttgcagcggcggcaagtcgcccatcgaggtggccaactacatccagaagacgctcagcggccagctcggcttcgagtgcaccgccataacgcgcaaggagaagtacagcatactcgccgggaccgacggccgcgtcccttccaagaacaaggagaaggaaaagaactagcgagtcacagcctcctatcgatcggagtactccgtattcgcccagccgactagtgtcactcatggcttctatctattgtttacgatttattgttgtttttcaagaagttggtaaattacatattgtttccgag

SEQ ID NO: 107 - DNA, 1521 bp, Oryza sativa
atggcggcggcggcggcggcggggaggaggaggttctttccgccggtgacggcgtacgacgcggcggcgggcgcgaggcggacggtggcggcggacctcgacgggacgctgctggtgtcgtcgtcggcgttcccgtactacttccttgtggctctcgaggccggcagctacctccgcgcgctggcgctgctgctcgccgcgccgtggctcctcgcgctctacgtcggcgtctccgaggccgccgccatcgccctgctcgtgttcatcacgttcgccgggctgcgcgtccgcgacgtcgaggccgtggcgcgcgccgtgctgccgcgccactacgccgccggggtgcgcgccgacacgtgggcggtgttccacggctgcgccgagcgccgcgtcgtggtcaccgcgtcgccggccgtcatggtgggggagttcgtgcgcgagttcctcggcgccgaggtggccggcaccgagctcgagacgttcgcctccggcaagcggttcaccggccgcatcaaggccgtcctcgtcggcgagaagaagcgcgaggtcgtcgagaggctcttcgccggcggcgacatgcccgacgtcggcctcggcgaccgcgagagcgaccacgacttcatggccatctgcaaggaagcctacatggtgcccaagaacaagcgcgcgccgcgcgccgccgccgacgagctgctgtcgcgcgccatcttccacgacggccgcctcgtccgccgcccggagccagcgagcgcgctgttcgcgctggcctacctccccgtgggcttcgccgtggcgctcctccgcgtgttcctcaacctccccgtcccggcgcgcctcgtccgccacacctaccgcctcaccggcatccgcctcgccgtgcgcggggcgccgccgccgccgccgcgcccggggacgccgggctccctcctggtgtgcaaccaccgcaccgcgctggaccccatcatcgtgtccatcgcgctgggccgccccgtgacgtgcgtgacgtacagcgttagccggctgtcgacggcgatctcgccgatccgcgcggcggcgctgacgcgggaccgcgcggcggacgcggcgcgcatcgcggcgctgctggaggagggggacgtggtggtgtgcccggaggggacgacgtgccgggagccgtacctgctgcggttctcggcgctgttcgcggagctgacggcgaggatcgtgccggtggcggtggaggcgaggcaggggacgtactatgggtcgacggcgagggggtggaagttcctggacccttacttcttctacatgaacccgcggccggggtacgaggtgacgttcctgccggcgctgaggccggaggagacgtgcgtcgccggcgggaggagcgcggtggaggtggcgaaccacgtgcagagggtgatcgccaaggagctagggttccaatgcaccacgctcaccaggaaggacaagtacatgaagctcgccggcaacgacggccgggtcgccgccgccgccgacaagcccaaggccaattga

SEQ ID NO: 108 - DNA, 1755 bp, Zea mays
aacccagacaggcaccgtaccaccgtgttccccgtcgccatggccgcgaggttccccccggtgtcgtcctacgacgcttcggcgcgggtccgccgcacggccgcggcggacctggacggcacgctgctggcgtcgtcgtcggcgttcccctactacttcctggtggcgctggaggccggctcctgcgcgcgcgcgctgctgctcctcctggccgcgccgctgctgctggcgctctacacgctggtctccgaggcggcggccatcgcgctgctggcgttcgtcacgttcgcggggctccgggtgcgcgacgtcgaggccgtcgcccggggcgtcctcccgcgccactacgccgcaggcgtgcgcgccgacacctgggccgtgttccgcgactgcggcgccgcgcggagggtcgtcgtcaccgcgtcccccgccgtcatggtcgccgacttcgtccgcgagttcctcggcgccgagctcgccgccaccgagctcgagacctgccgcgcgctcggcgacgcctggttcacgggcaggatcaaggccgtgctcgtcggggagaggaaggccgaggtcgtgcgccggctcttcgccgccggcgacctgcccgacgtcgggctcggggaccgcgagagcgaccacgacttcatggccatctgcaaggaggcttacatggtgcctccggaccggcgcgcgccgcgagcggccgcggacgcgctgctgtcccgcgccgtcttccacgacggccgcctcgtgcggcgcccggacccggcgcacgcgctcttcgcgctggcctacctccctctcggcttcctgctggcgctgttccgcgtgctcttcaacctcgccatgccggcgcgcctggtccgccacacgtaccgcctgacggggatccggctccgcgtgcgcgggactccgccgccggccccggcgccgggcgcgccggggtcgctgctggtgtgcaaccaccgcacggcgctggaccccatcatcgtgtcggtggcgctggggcggcccgtggcgtgcgtgacctacagcgtgagccggctgtcgacggcggtgtcgccggtccgcgcggtggcgctgtcgcgggaccgggcggccgacgcggcgcgtatagcggcgctgctggcggagggcgacgtggtggtgtgccccgaggggaccacgtgccgggagccctgcctgctgcgcttctcggcgctgttcgcggagctcacggaccggatcgtgcccgtggcgctggacgcgcggcaggggacctactacgggtccacggcgagggggtggaagtggctcgacccttacttcttctacatgaacccgcgccccgggtacgacgtcaccttcctgccgccgctgcggccggaggagacgtgcggcgccggcgggaggagcgccgtcgacgtggccaaccacgtgcagacgctcatcgccaaggagctcgggttccggtgcaccaagctcaccaggaaggacaagtacatgaagctcgccggcaacgacggcacggtcgggggcaggcctgagaatgagaagggcgccgccgatgatagtgctgccacggccaccaccaagaagcttgtataaagagactgtatttatagctagctggtcgactgtatcggagcagcatccattatgtatttatgtacgtatgctaatgacgacaacattagtgtgatgtgatggattcgtgaacatagaagattacaagcttaacttcatgtttaccatgaccaaaaaaaaaaaaaaaaa

SEQ ID NO: 109 - DNA, 1852 bp, Zea mays
gcgcgcgtatattaactccacctcgccgccccactccactgccaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcarcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggccaggccaggcgtgctcgtcggcgaccacaagaagaaggccgtcgtcaaggagctcggcgacgcgctgcccgacgtcggcatgggggatagggagaccgacttcgacttcatgtccatctgcaaggaggcctacctggtgacgtcaaggaagtacagcccggtgcccaggaaccagctgctgagcccgctgatcgtgcacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtcaagggcaccccgccgccgccgcccaagaagggccacccgggcgtcctcttcgtctgcaaccaccgcaccgtgctcgaccccgtcgaggtggccgtggcgctgcgccgcaaggtcagctgcgtcacctacagcatctccaagttctccgagctcatctcgcccatcaaggccgtcgcgctgtcgcgggagcgcgacaaggacgccgagaacatccgccgcctgctggaggagggcgacctggtcatctgccccgagggcaccacctgccgcgagcccttcctgctgcgcttcagcgcgctcttcgccgagctcaccgaccgcatcgtgcccgtggccatcaacaccaaggagaccatgttccacggctccaccgtgcgcggcttcaagctcatggatccctacttcttcttcatgaacccgcgcccgacgtacgagatcacgttcctcacccagctccccaaagacctcacgtgcagcggcggcaagtcgcccatcgaggtggccaactatatccagaagacgctcagcggacagcttggcttcgagtgcacgtccatcacgcgcaaggagaagtacggcatgctcgctggcaccgacggccgtgtcccgtccaagaacaaggagaaggagaaggataagaactaacggccaacgtcgctcttcctgcttgcccagaagactgccgtttaattactgctcaaatttattccaatttattgttccttgtcgaaaagttggccagtgtgatgtgggccgtgtactagtacaagcttgatgatcattagtatgtctacaattcttcctttccggaagaagggaggaagagttgatagagccgtcttaatacaaagtttcgccaaaaaaaaaaaaaaaa

SEQ ID NO: 110 - DNA, 1704 bp, Zea mays
caccaatataatcaccatttctgttcacgcgatcgagaggcaaaattaagcatggtgtcccgaaggttcaagccgatcgagctgtgcgactccgaggggcggtcgcgccagacggtcgccgccgacctcgacggcacgctcctcctgtcccgcagcgcgttcccgtactacctcctcatcgcgctggaggccggtagcctccttcgcgcggtggcgcttctcttgtccgtgcccctcgtgtacctcacctacgtgaccgtgtccgagaccctggccgtgcgcgcgttcatctacgtcgccatggccgggctggaggcgagggacatcgaggccgtcgcccggtccgtgctccccagcttctacgccggcgacgtccacccggagggctggcgcgtgttccgctcgttcggcaggaggtgcgtcgtcaccgccagcccgcgcctcatggtggagccgttcgccaaggcgtttcttggcgcggacgtggtgatcgggacggaggtggaggtggcccagtccgggaaggccacggggttcgttgccgggcccggggtgctcgtcggcgagcacaagaggcgggcggtggcgagggagttcggcgactcgctgccggacgtcggcatgggggatcgcgagagcgacttcgacttcatgtccatctgcaaggaagcgtacaccgtaacacgacagaagtaccgcgcgctgccccgggatcagctgcagggccgggccatcctccacgacggccgcctggcccgccgcccgacggcgaccaacgcgcttctcactttcctgtggatgccgctcggcttcgcgctcgcgctggtgcgcgcgcatctgcacctgctcctcccggtgcgcgccctcgcctacgcctacaagcttacgggcgtcaagctggtggtgcgcggcaacaggccgccgccgtccaagaagaagaagggcgaccagctaggggttctcttcgtgtgcaaccaccgtagcacgctcgacgccgtcgcggtgggcgtcgcgctgggccgcaaggtgagatgggtcgtcacagacggcggtgcgggtgcctccaggttctcggagcccgtagtgtcgcctatcatgacaggcgtgccgctgcccgtgcccaccagcctcgagggcgacgccgacgcggacgccgccccccgcatccggcggctgctcgaggagggagacgacgtcgtcgtcttccccgagggcgccatctgccgcgagccgttcctgctgcggttcggcgcgctcttcgctgaggtcaccgaccgcatcgtgcccgtggccatcgaacctagggagagcatgtttcacgggtccacggcgcgcgggctcagagggatggatccctacttctttttcatgaacccacggccgacgtacgaggtcacgttcctgaaccagcttccaggggagctcacctgcggcggcgggaggtcgccggtcgaggtggccagctacgtccaggaggtcctggccgcgcagcttggattcgagtgcacctgatgaagcagcaagtgcaaaagtggcatggtgacggttgcgtggcgttcaaaggtggactagggaacacagagcatgcaaccaactgtcaattgccgtgtgttgagagtggtgatcagttcatggtttcacgtttgctgttgatgtctgtgataagaaccatatgtatctctacaactattaagagcgttgtgt

SEQ ID NO: 111 - DNA, 1845 bp, Arabidopsis thaliana; identical to SEQ ID NO: 85

SEQ ID NO: 112 - DNA, 1872 bp, Arabidopsis thaliana
caatataggtgcatttaaaacataacgttccctctcttgtcttcttatttttgctctctgttctttagaactgccattaacgagagtgagagagagagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaagaaaggttacatggttcatgcgaccaagtcagccacaacgattccaaaagaacgcttaaagaaccgcatagtcttccatgatgggcgtttagcgcaacgtccaactccgttaaacgccattatcacatacctatggcttccttttggtttcatcctctccatcattcgcgtctacttcaacctccctttacctgaaagatttgtccgttacacttacgagatgctcgggatccacttaaccattcgtggtcatcgtcctccacctccttcccctggaactcttggcaacctctatgtccttaaccaccgtaccgcgcttgatcccatcatcgttgctattgctcttggacgtaagatctgttgcgtcacttacagtgtctctcgtctctcccttatgctttctcctattcctgctgttgccctcacccgtgaccgtgccaccgatgctgccaacatgagaaaacttctcgagaaaggcgacttggtgatatgtccggaaggcacgacgtgtagagaagagtatctactgagatttagcgctctattcgcagagctaagcgaccggattgtgccagtagcgatgaactgtaaacaaggaatgttcaacgggaccacagttaggggtgtgaagttttgggacccttacttcttcttcatgaacccaagaccaagctatgaagccactttcttggatcgtttgcctgaagaaatgactgtcaacggtggtggcaagactcctatagaggtggctaattacgtccagaaagttatcggcgcggttttgggcttcgaatgcaccgaacttactcgcaaggataaatatcttttgcttggaggtaatgacggcaaggtggagtctatcaacaacaccaagaagtgaatatcttattcttgttataacttggcattgacttattgcaagtaaggttggatcatatacgaattttcatgtgtgtaattgcttgagctcttgtcatcattatggtacgttattgttatgtttattctattttgttcttaatgtcgaacgggtaactatatccttaaaaactattttgtgatcccgtttctatacggatgtgtatagagactttctatttaaagtgcaaaattttattggaggaagtaaa

SEQ ID NO: 113 - DNA, 1545 bp, Physcomitrella patens
atgcagcaactcgacccattgactagttttcactgcagtgaaagcttcgaaggagtggagacctgcagagtggaagggcgtgcgaaccagagcattgtttcagatttggacggaacgcttctgcggtcaagaagctcttttccctactttatgttgctcgctttcgaagcagggagcccactccggtctgtcgttcttctgcttatttctcccgtagtatggcttgtctacaacttcgtctccgaggcagctgggattaagatgctcattttcgtctcgctggcgggactcaaagtgtccgccgtcgagtcagtggcgcggggtgttctgcccaaattctacttggaagacatgcactccatcagctaccgagtcttcacctcctgcgggaagcgctacgtcgtgacggcgaatccaaggatcatagtggagccgtttctgaaagagtatcttgacgtagaagctgtaatgggcactgaactacaaatctcgagcgggggatatgtcaccggttttgtaacgggccccggtgtactcgttggtgctgtcaaagagcgagctgtgaagaaatactttggacccgaccctccggacgtcggcctaggagacaggcagagcgacttcttattcatggatctctgcaaggaatcttacattgtacacagcgacaaggatgtgcccgccgtgtcgaaggaagacttcttaaaacctcttatcttccacgacggtagactggtgtgccgtcctacgccgctgatgtcgcttatcgtcatgctatggtgtcctattggctttgtccttgccgttgttcggatgctcatcggcattgcgttgccaatgtggtgggcgcttcctcttgaggcaatgctcggcgtcaccgtccgtgtgaaaggaattcccccgacgtgccccctccgaaacaagaagcggggtgtgctcttcgtgtgctctcatcgcactcttcttgaccctattttcttgtccattgccgttcgaaggaaagtcactgcagtaacatacagcatcagtcggctctccgaagtgctgtccccaatccgcactgtgcgcctcacgagggacaggaacacggacgccaacaccatggcaagtctattggaggaaggtgaccttgtggtgtgccccgagggcaccacttgccgggagccttatctgttgcggttcagttccttgttcgctgagctgacggatcaaattgtccccgtgacgatgaatatcaaaattaccatgtttcatgggacgagcgctcgaggctggaaaggcatggaccccttcttcttcttcatgaacccttgccctaagtatgaggtaacatttctggaccaactcccgcatcagctgacatgcaatggcggaaagaccagccacgaggtggcgaactacattcagcgcgtgttagcgaactctcttggatttcagtgcaccaatctcacgcgcaaggacaagtatactgtattggccgggaacgatgggattgtgccggatcacactctgcggcagcgagctggcagaatgttcggcttgtag

SEQ ID NO: 114 - DNA, 1506 bp, Physcomitrella patens
atgaagagagatcccttcgataccatcgacaagtgcagtgacaaaggcagaagcaagcagacggttgtctcggatctcgacggaactcttcttcgcagccgaagctcgttcccctacttcatgctggtggcattcgaagctggaggagtggcccgggcctttgtgctcctcttgtgctctccgctgtgttggcttctgtaccattgcgtctcagaatccatcggcattcgcctcctgatctttgtcaccttcgcgggcctaaaaatcggcggtatcgaagccatcgcacgcggaacgttgccaaagttttacgcggaagacgtgcatccggacacatggcgaatcttttcttcgtttggggagcggtacatacttacggcgacgccgcggatcatggcggagaccttcgccaagacgtatctgggagtggacggtgtgttggggacggagctgcatttcacttctggcggcatcgcgactggtttgttgatgaacccaggggttctaaccgggagaaacaaagaaattgtgctgaggcaagaattccaaggcttgaaccttcctgacgtgggtctcggagaccgtccgtccgaccacaacttcatgtccatttgcaaagaaggatacatcgttccgccgagcaacacaatactggcagcgtcgaaagaaagtctaatgaacctgctggtgtttcacgacggccgcctgatccaaaggcccacagcaggcatagcgctcatcatactgctgtggtacccgattggcgctgtgttggccgtgcttcggatcctggctggcatccttcttcccttccacttgttgaaattggtatacaagtttcttggggttggggtggtggttcgtgggaccccacccccagagcccaaagacggccccggacgaggaggctacctgtacgtgtgctcgcataggacgctactagaccccgtgatggtgggcgtggcgttgaagcggcgcgtgacggccgtcacgtacagcataagccggctgtcggaggtgttgtccccaatcaaaacagtggcactgaagaggaatcgggagaaagacgcggcgaagatcaggtctctgctgcgagaaggagaccttgcgatctgccccgagggcaccacctgtcgggagccgtatctgctgcgattcagcgcgctgttcgcggagctgtcgaaccagttggtacctgtggcgatgaacacgcgcatgagcatgttccacggcaccaccgcgcaggggtggaaatgcttggaccctttctacttcttcatgaatcccaaccctatctatgaggttacgttcctcaacgaattaccggttgagcttacatgtgccggtgggaaatcttcgtatgaagttgcgaaccacatccaacaacttttgtcgcaaacgttgggctttgaatgcacaaattatacacgaaaagacaagtatggggtgctctgtggaaacgacggttcaattcctttaaagtctcaagactcctttggttcgtag

SEQ ID NO: 115 - DNA, 2100 bp, Physcomitrella patens
atggagacgcaagaacccgaccctgtcacaagctttcactgcagcgaaaactatgacgaggtggagaactgcagggtggagggtcgggcaaatcagagcattgtatcagatttggacggaacgcttcttcggtcgcgaagctccttcccctatttcatgctgctagccttcgaagccggtagtccattacggttcatcattcttcttcttgtctctcccatcgtttggttcgtctacaacttcatctctgaggtagtcggtattaagatgctaatattcatatcgcttgcggggctcaaagtgtcagccattgagtcagtggcgcgtggtgtactgccgaaatttttcttggaggacatgcactccatcagctacagagtgtttatttcctgcgagaaacgctacgtcgtcacagccaatccaaggataatagtggagccattccttaaggagtatttagatgtagacgctgtgatgggcaccgagcttcaaatttcgagtgggggatatgctaccggcttcgtcaccggccctggtgtcttagtggggacagcgaagcaacgagctgtgaagaaatattttgggtccgaccagccggaccttggcctaggggaccgaacgagcgacttcgcattcatggacctctgcaaagaggcttacatagtgcctagctataaggaggtgccgtccgtgacgaagaaagactacttgaagccgttgattttccatgacggaaggctggtgtgtcgtcctacgccgctgatggcgctggcggtgacactttggtgcccgattggcttcgtcttggccatcatccgaatgttcattggcataatgttaccaatgtggtgggctctccctctagaagccatgcttggcgtcacggtccgtataaagggaattcccccgacatgtccccttcggagcaagaaacgcggcgtgctgttcgtttgttcacatcgcactctcctggaccccattttcttgtctatagccgtgcgaaggaaagtcacggcagtgacgtacagcatcagtcggttgtcggaagtcctggctccgatccgaactgtacgtctcacgagagacaggaacacagatgcgagcactatggctagtctcttggacgagggtgacctcgtagtgtgtcctgagggcaccacttgccgcgagccttatcttctgcggttcagttccttgtttgcagaattgactgaccaaatcgtccccgtaaccatgaacatcaagatttcaatgtttcatgggacgagtgctcgaggctggaagggcatggatccgttctttttctttatgaacccccgccctaagtacgaggtaacattcttagatcaactcccgcatcagttgacttgcaatggcggaaaaactagccacgaggttgcgaattacatccagcgtgtgttggcgaactctctcggatttcaatgcaccaatcttacgcgcaaagataagtacagggtgttggcggggaacgatggaattgtaccagatcgaagtctgcggcagagggccagcagaatatttggtttgcagtgacattagggtttacttgtaacgccacatgtcaaatcgcagcatcggatggtcctgtacccaaataatttcctaggtggcggaggaccgatttttttcctcaaattgtgcggagttagggaaaaccttcggtccccagctatgacccacatgtgctgcgttgtctgcatccagcccgacctcaactgtgtcgagcttctgctgttgattgattgacaccgactagaaaccaaatagtacaattttaagaggataaacatcgtgttataatttggaaagttgaaccatacaattcctttctatcagttacagcgtttgactaactacagaaacaggaagacactgttggacattgctctatctgcggcggtaaaaaggacactggctgcttttcagagacgacatataacttcggcttatgactgagttcttgttgctcctcaaaccttgaactgtaggactgtagctagtgtctctgctgtctcgcctgtaagcagaagcattaggcgtttgtattgtgtattattcctaccattcattgaaggacat

SEQ ID NO: 116 - DNA, 1676 bp, Physcomitrella patens
atggaggtgacgaagttgaaagaggccgggaactacagcttcgcggaggtgaaatcgtgcagctcagggaatgatcgcaggagccagaccgtggtggcggacttggacggcaccctcattcgggggcggtccgctttcccgtatttcttcctggtggcgttcgaggccgggagttacttcagggcgctgctgctgtcgctcatggcgccgctcattgggtttctctactactttgtggacgaggcgtccgggattcacctcatgatctttctctcattcgcggggctgaagattaaggacattgagggtgtggcgcgcgctgtgcttaccaagttctacgccgatgaccttcaccctgagacttggcgggtgttctcgagctttggcaagcgtgtggtgctgacggcaaacccgcgcgtgatggtggagccgtttctgaaggaggtcctcggcgcggacgaggttatggggacggagattgaggtgaacaaaaagggccgcgctacaggcaggcttctgaagccgggtgttctggttgggacacacaaggaggaagctctaaagcggtgtaacattggaggtgagcgcccgcacgtcgggctaggcgaccgcgttacggatttccctttcatggcgtactgcaaggaaggctatgtagtacccaaaacgaaagtgccagccgttaagaagcaagacatgccgaagcagctaatctttcatgacggtcggcttgtgcaactcccaacgccccgtaatgctttcaaagtgctggcatggatgcctatcggcctgcttttgtccatcgtccgcgtcacgatgggtgtatgggtccccatacgcttgatgccactgtgttacaaactcacaggcatcaacctcgttgttaagggaaacatccctgagaagcccaagaatggagaacccgggagactcttcgtctgcaaccaccggactcttctggaccccgtcatcatcgctctggcgcttgggcgccccgtccctgccgtgacttactccatatccaaagtctcagagttcctgtcccccatgccaacaatcggcctgtgccgagatagggagaaagactcggccaatatgagaagggtgctgaaagagggtgagctcactctttgtcctgagggcactacttgcagggagcctttcttgcttcgattctcagctctcttcgccgagttgagtgacaggattgttcctgtggccgtaaaaattaacatgaatatgtttcacggcacaactgctcgcggtaacaaagccatggaccccttctttgcttacatgaaccctcggccgaccatcgaactcaaattcctagacgagattccaaagaacatgacatgtggtagcggaaaatcgtccattgaagtggcgaactacatacaacatctccttgccggagaactcggatatgattgcacagatttcactcgcaaggataagtaccggttgctcgcaggaaacgatggcattgtacctgttaaggagaaaacgaggtaatgaatcgacctgcaagcacattaccacagaacaagacattgaaagtgcttacgattcagtatcactagatggaggggttaaccccgactcagtactataagtgtagaattcagtgccaaaggcaataaactgtgattgattgttacataaactcgatgcaa

SEQ ID NO: 117 - DNA, 1590 bp, Physcomitrella patens
atggaaattccaggagtgtttgatgctaatctcttctgcgctgagtcatttcctgaagtcgaaacttgtaaagtggaaggtcgtgaaaaacagacgattatttcagacttagatgggacgctcctcagatcaagaagctcgttcccttacttcatgctcattgcgttcgacgctggaagccctctccgcttcatcgtcctcttgctggcctctccaataatttggctggtctacaacttcttctccgaggctgccggtaccaaactgctcattttcattgcatgtgctggcttgaaagcgtccgacatcgagtctgtagcgcgcggcgtgttgcccaaattttacttggaagacatgcactccgtcagctacagcatcttcgtctcctgcggtaagcggtatgtggtgactgcgaatccgcgcatcatggtagagtcatttctgaaagagtacatgggcgtcgaggcagtcataggtactgagcttcatatcacgaagagcggttacgccacgggtttggtaatgggtgccggtgtgattgtgggagctaacaaaacgcgcgctgtgaagaaatactttggcgatgaccttccagacatcgctctcggagaccgagccagcgactttccttttatggctctttgcaaggaggcatacttagtaccgagcttcaagcctgtcgagccagttgccaaagctgactacctgaagccgctcattttccatgacggcagattagtatgtcgaccaacacctctcatgtcactcgtaattattctctggtcgccgatcggtcttattctagcactcattcggatggtgtttggcaccgtgttacccatgtggtatgcgctgccgctggaggccatgcttggcgttagcatccgcgtgaaaggaatcccccccagctgcccccaaaccagcggcagacgcggtgtgctcttcgtctgctctcaccgcactttgctcgaccccatcttcctgtcaatagcctgtcggcgacaagttacagcagtaacctacagcatcagcaaggtctcggagatactgtcgccgatccccacagtccgactcacaaggtgtcggaaaaccgatgcggagaccatgacaaagcttctcaacgagggagatcttgcagtgtgcccagaaggcacgacgtgccgcgagccataccttcttcggttcagctccttgttcgcggagttagccgaccaaatcattcccgtcacgatgaacgtcaaaacgaccatgttccacggcacgacagcccggggctggaaggcactggacccctttatctttctgatgaatcccagccctaggtatgaattggagtttctagatcagcttccgcacgagatgacctgcagcggcgggaagagtagtcacgaggttgcgaactacattcaacgagtcctcgcggcatctctgggtttcaagtgcacgaacctgacgcggcgagacaagtatcgaatcttagcagggaacgatggcgtggttcctgcaagccattttttgaaacaaagaagcaggatcttcgcatgcttgccttccaggaatagtgagagaggccagcgatcagacccgtaa

SEQ ID NO: 118 - DNA, 1512 bp, Vitis vinifera
atggctgtaactacctttccaactgtggaccagtgtcaatccattggccgagaaaagcacactgtggttgcggacatggatggaaccttgcttattggcaggagctcctttccttactttgctttggtggcttttgaggggggaggtgttctaaggctgctcttcctgctcttggcttcaccactcgctggacttctttactattttgtgtcggagtctgcaggaatccagattctcatctttgtaaccttcgctgggatgaaggtgtcagacattgagtcagttgcacgtgctgtgctgcccaaattttatttgagcgatctccatcccgagtcatggcgggtgttctcatcatgtggaaagcgttgtgttcttaccgcaaaccccaggataatggttgaggcatttctgaaagattttttgggagctgatttagttttggggactgagatagccacttataagggtagggcaactgggtttgtttgtgatccaggtgtacttgtgggcaagaacaaggcatatgctctcaacaagacttttggagagacccagcctgagattgggctgggtgatcgtcacactgattttcccttcatggcttcatgcaaggagggctatattgtggcagccaaaccagaggttaaggcggtaacaagtgacaagcttcccaagcccatcatcttccacgacagccgcctcgtccaaaagccaactcctctcacggcactcctcacccttctctggatccccataggcttcgcactcgcatgcttgcgaatcgccgctggctcactcctccccatgcgcattgtctaccacgctttctgggcactgggtgtccgagtctccgtcaagggttccccacctcctgttgccaaaaagtcaataggccagtcaggcgtgctattcatctgctcccaccgaaccctccttgacccaatattcctctccgcagcgctcggccgtcccattcctgcagtcacgtactccgtctcccgcctctccgagttcatctcccctatcaaaaccattcgcctaagccgagatcgagtcaaagacgcagccatgataaagaaactgcttgaagaaggtgacctagctatttgccccgaaggaaccacttgccgtgagcctttccttctcaggttctcagcattgtttgctgaactgactgaccagcttgttccagtggctatgatgaaccgcatgagcatgttccatggaacaacagcaagagggtggaaagggatggacccatttttcttcttcatgaatccaagcccagcgtatgaggtaacgttcttgaacaagctgcccctggaacttacttgcagttcggggaaatctagccatgaggtggccaactacatgcagagggtgattgctgccactctttcctatgaatgcactagctttaccaggaaagataagtaccgagcactcgctggaaatgatgggaccgtgcccaaaaaacctctgctatatcccgacaaagtcatgggatgctga

SEQ ID NO: 119 - DNA, 1784 bp, Vitis vinifera
gtttcttttcgttgtccactgtgctgcctgaaaggctgaatccggttctaccggccgagacatgtctccgccaccgaaacgcgcccgaaaatttccctccatcactacctacgccggcggcgaccatcgctctattgcggccgacctcgatggcactctcctcgtctctcgctcctccttcccttacttcatgcttgtcgccgtcgaagccggcagcctcctacgcggtctcttccttctgctctctcttcctatagtgatcgttgcctacctcttcatctcagaagaaatcggaattcagattctcatcttcatttcattttccggcctcaagatccgagacatcgagctcgcgtcgcaggcggtgctgccgcggttctacgccaacgacgtgaggcgagagagctgggaggtgttcgagaagtgcgaacggaaggtggtggtgacggccaacccgacgttgatggttgagccgttcgtgagagattttcttggcggaacgaaggtgttagggacggagattgaggtgaatccgaagacgaagaaggccactggtttcgtgaagaagccaggggtgttggttggagacagaaagagattggcgctgttgaaggagtttggtgatgaattgcctgatatcgggattggtgaccgcgagtctgatcatgatttcatgtccatttgcaaggagggatacatggtgcttccgagtaaatcagctacgccggtgccacccaaccgcctgaaaaccccaataatattccacgatggtcggttcgtccaaccccccacgccactcacggccctcatcatctacctctggcttccatttgggtttgcactctctatcttccgagtctacttcaacctccccctcccagagcgcatcgtccgctacacctacccgatgctgggcatcaaccttgttatccgaggcaaccctcctccgcccccctccccaggttcccccggcaacctctacgtctgcaaccaccgcaccgccttggaccccatcgtcatcgccatcgccctccgccgcaaggtctcctgcgtcacctacagcgtcagccgcctctctcgcttcctctcccccatccccgccgtcgccctcacccgcgaccgcgccgccgacgctgcccgcatctcctccattctccagaagggcgacctcgtggtctgcccagaggggaccacctgccgcgagccctacctcctccggtttagcgcactgttcgcggaactcagcgaccgcatcgtgccggtggcggtgaacgtgaagcagaacatgttccacggcaccaccgtccgaggggtgaagttctgggacgcctatttttacttcatgaaccctcggcccacctatgagataacgtttctggatcggttgccggaggagatgacgtgtaaggccggagggaagtcggccatagaagtggcgaatcacgtgcaaaaggtgttgggtggagtgctggggtttgagtgcactggactgactagaaaggataagtacatgttgctgggaggaaatgatggcaaggtggaatccatgtacaatgccaagaagtgaaaggctgggatcggagaagaaggccacattggaattgtatgggttttagaaaaattacgagggaggtatatcggttaatgtagaattacaacttctatggaaattcccttagtatgattgataattgttgatcatttttcatctggattattcatattatttggacattcaagtttagagttatgaagagtgtcttctgatttctgtggttgatttt

SEQ ID NO: 120 - DNA, 1533 bp, Vitis vinifera
atgaccaaatcaaacctccactctcctcccacctccctaaccatcgatcaatgcacctccatcggccgggaaaaggagacggttgtggcggacatggacggaactcttctcagagggcgcagttcgttcccctactttgcacttgttgccttcgaggttggtgggatttttaggcttcttctgttgttgctatgttctccattggctggagttctctactacttcatatcggagccagctggcattcaggtgctcatattcgcgacctttgtggggatgaaggtttcggatatcgagtcggtggcgcgggcagttttgcccaagttttacgcgagcgacctgcacccggaggcgtggagggtgttctcgtcgtgtgggaagaggtgtgtgctcaccgcgaatccgaggattatggtggaggccttcctgaaggattttttgggtgcagacatggtgttggggacggaggtggacacgtataaagggagagctactgggcttgtccgtggtggtggggttcttgttgggaagagaaaggcagaggccctccgaaatgccttcagcgagacgtctttaccggagattggactcggtgatcgggagacggattatccatttatgagtctctgcaaggagagttacatagttccagcgaagcctgaggtggaggctgttagccatgacaaattgccaaagcccattgtattccacgacggccgcctcgtccaaaaaccaacccctttcatggcgcttctcaccatcctctggatcccagtaggcttcctcttggcctgcttgcgcatcgccgctggtgcgctccttccaatgccgcttgtctactacgccttttgggcactcggtgtcagagtttatatcaagggcaacccccctccaccagccaaaaaatcaataggccaatctggcgtcctcttcatttgctctcacagaaccctcctcgaccctatcttcctctccgccgcattaggccgccctatccctgcagtcacgtactccctttctcgtctctccgaattcatctcccccatcaagacagtccggctcagtcgcgatcgagccaccgacgcagcaatgataaagaagctcttagaggcaggtgacctagccatatgtcccgaaggaaccacttgcagggagccatttctgctaagattttctgccttgttttctgagctaaccgacgagctggtgccggtggctatggcaaaccgcatgaccatgtttcatgggacaacagctagaggttggaaggggatggaccccttttactacttcatgaaccctagccctgcctatgaggtaaacttcttgaataagcttccacatgagctcacttgcggtgctggaaaatcgagccacgacgtcgcgaactacatacagaggatgattgccgcaagtctatcatatgagtgcaccaacttcactaggaaggataagtatcgggcactggccgggaacgatggaactgtagtggaaaagcccaaggttgatgctaataaagtcatgggctgctag

SEQ ID NO: 121 - DNA, 1726 bp, Vitis vinifera
atgggggctcaacgccatttccaaccaatatcgaaatgcagctccgacggtcgagccaatcagacagtggcggcagacttagatggcacgcttcttgtgtcccgaagcgcatttccctacttcatgcttgtggcacttgaagctggtagccttgtgagggcaatcctcctcctagcatcggttccactagtgtatttcatttacttgttcatttcggagtcgctagccattaaaatctttatctatatggcttttgcgggactcaaagttagagagattgagcttgtttcgaggtcagtcctgcccaagttctatgctgaggatgtgcaccccgagagttggagagtgtttaattcctttgggaagaggtatatcattactgccaatcctagaattatggtggaaccctttgtgaagacctatatgggtgccgataaggttcttgggaccgagttggaagtatcgaactccggaagggcgactgggtttgtgaagaaaccaggagttttggttggggaacataagaaagcggcagtgcagcaagaatttggcatgaatttgccagatgtgggcctgggagatagagatacggatcatgatttcatgtccttatgcaaggaaggatacatggtgccaaggacaaaatgtgagccactaccaaggaacaagcttctgagtccagtcatttttcacgagggacgtttggttcagagacccacccctgtggctgccctgttgactttcttatggatgccaattgggatcattctctccatccttagggtctacctcaacattcccttgccagagcgtattgtgaggtacaattacaagatcctgggaatcaagcttattgttaagggtacacctcctcccccgccaaagggaggccaaagtggagtcctcttcgtttgcaaccataggacagttttggaccccgtggtcacggctgtggctttaggcagaaaaatcagctgtgtcacttacagtattagcaaattctcggagctaatttctccaatcaaagccgttgcactatccagggagagagaaaaggatgcagcaaatatcaagcgcttacttgaagaaggtgatttagtaatttgtccggagggaactacatgtagagagccatttctgttgagatttagcgccctttttgctgagctcactgatagaattgtgcctgttgccattaataccaagcagagcgtgttttatggcacgtcaacccggggttataagttgttggatccttacttcgtgttcatgaatccaatgcccacctacgagatcaccttcttgaatcagctgcccgccgagctcacttgcaaaggtgggaaatccccaatcgaagttgcaaattacatccagagggtgctggctggaacccttggctttgagtgcactaacttgaccaggaaggacaaatacgccacacttgccggaacagacggcagtgttccgttcaagaacgaaaaggaaaaggaaaaggcttgagaactgaaagtgattcaaagtaaattaattagtctcatgattttctattgttttacatatattatatgccggaatcattatcatgacaatgaactccgattgtgatgataataaattgttgtgattataaaaataatagtttcttatattgtcgtggagacaagtcaacggtcattttttttaagtttttgaaaataaattttatctggacaagtttcaccttaga

SEQ ID NO: 122 - DNA, 1504 bp, Populus trichocarpa
tcctctctcatggtaatgggggctcatcgccattttgaaccaatagcaaaatgtagcacagagggacgatcaaatcagactgtggctgccgacctggatggaacacttcttgtatcaagaagtgcttttccatacttcttgcttgttgctattgaagctgggagtctcttaagaggactaattctcttagcatcagtcccatttgtatactttacgtacttatttatatcagaggcaatggcaatcaagactttcatcttcattgcctttgcgggacttaaaataagagacattgagcttgtttcaaggtctgtcttgccaaagttttatgctgatgatgttcatccagaaacttggagggtgttcaattcttttggaaaaagatacattgttactgctaatcctaggattatggtcgagccatttgtcaagacctttttaggggctgacaaggttcttggcactgaattagaggctacaaaatctggaagagcaactgggtttatcaagaaacctggagttcttgttggagatcataaaagagatgctctcttaaaagagtttggcacaaatttgcctgatttaggcctgggagaccgcgaaactgaccatgacttcatgtccatttgcaaggaaggatatatggtgccaggaaccaagtgtgagcctctagcaagaaacaagcttctaagccctgtcatattccacgatggccggttagttcaaaggcctactcctttggctgcccttttgaccttcttatggatgccaattggtattattctctccatacttagagtctaccttaacatccctttgcccgagagacttgcctggtacacttataagctactaggaattagagttattgtcaagggtacccctccaccccctccaggaaaaggccacagtggagtcctctttgtttgcaatcatcgtactgtcttagacccagttgtcactgctgttgcactaggaagaaaaattagttgtgtcacctatagcataagcaagttcactgaaattatttcacccattaaagctgttgctttatcaagggagagagacaaagatgctgctaacattaagcgactgcttgaagaaggtgacctggtcatttgccctgaaggaaccacatgtagagagccatttctcttgagatttagtgctctttttgctgagcttactgataggattgtgccagttgctatcaatacaaaacaaagtgtgtttcatggcacgacggttcgagggcacaaactgttggacccttattttgtgttcatgaatccaatgccaacatatgaggtcaccttcttgaatcagctgcccaaagagcttacttgcaaaggaggcaaatcagccattgaagttgcaaattacatacaaagggtgctggctgggacacttggatttgagtgcactaacttgaccaggaaggacaagtatgctaagcttgcaggaacagacggccgtgttctatctaagaaggaaaatgcttgag

SEQ ID NO: 123 - DNA, 1506 bp, Populus trichocarpa
atggttagcttcccaactgttgacaaatgtgcatccatcggcagagaaaagcacagtgtagttgctgacatggatgggaccttgcttagaggccgtagctcattcccttactttgctctacttgccttcgaagctggtgggatttttaggctgcttttcttgctcttgaactcaccactagcaggacttctgtattactttgtgtccgagtctgctggtattaaagttcttatctttgctacatgtgccggaatgaagttatcagatatcgagtctgtagcacgtgctgtgctgccaaagttttactctagtgaccttcattctgagtcgtggcgtgtgttctcttcttgcggaaaacgttgcgttcttactgcaaatccaagaattatggtggaagcatttttgaaagatttcttgggagctgatttggttttggggactgagatattaacttataaaggtagagcaacagggtttgttcagagcccgggagtacttgtggggaagaacaaggcagatgcccttaaaaaggcttttgggaagacacaaccagagattggacttggagatcgtcatacagatgcacccttcatggctctatgcaaggagggctacatagtgccacctaagccagaggttgaagctgtaactactgacaagctcccaaaaccagtcatcttccatgatggccggctagtccaaaaaccaacaccattatcagcactactcataattctctggatccctataggcttcattttagcctgcttgaggattgcagcagggtcactcctgcctatgccaatggtctactatgctttctgggcacttggtgtccgtgtcaacataaagggaaccccacctcccccagccaaaaaatcaattggtcaatctggtgtcctctttgtttgctcacacagaaccttgcttgatcccatatttctctccactgcccttgggcgccctattccagcagttacatactcactttctcgtctctctgaaattatctcaccaatcaaaactgttagactcagccgtgaccgagctgcagacgcatcaatgatcaagaagttattagaagaaggtgacctagctatatgtcccgagcgaactacttgccgcgaaccgtttcttttaaggttctcggctttgtttgctgaattaacagacgaactcgttccagtggctatggcgaatcgcatgagtatgtttcacggaaccactgcaagaggctggaaagggatggatccattttacttcttcatgaaccctagcccagcatatgaagtaactttcctgaacaagttgccactagagctaacattaagtggtgggaaatctagccatgaggtggcaaactacatacaaagagtgattgctgctactctctcctatgaatgcacttcctttactaggagagacaagtacagggcacttgctgggaatgatgggaatgtggttgaaaagacgaaggtccaagccaacaaagtaatggggtgttaa

SEQ ID NO: 124 - DNA, 1506 bp, Populus trichocarpa
atggatagctttccaactgttgacaaatgtgcatccataggtagagaaaagcacactgtggtagctgacatggatggaaccctgcttagaggtcgtagctcattcccttactttgctctacttgcctttgaagctggtgggatttttaggctgattttcttgctattggcctcaccgctagcaggacttctatactactttgtgtccgagtctgctggtattaaggttcttatatttgctacatgtgccggaatgaaggtttccgatattgagtctgtggctcgtgctgtactgcctaagttttactctagcgatcttcattctgagtcgtggcgtgtgttttcttcttgtggaaaacgatgtgttcttactgcaaatccaagaattatggtggaagcatttttgaaagatttcttgggagctgatttggttttggggacagagatgtctacttataaaggtagagcaacagggtttgttcagagcccgggagtacttgtggggaagaacaaggcagatgcccttaaaaaggcttttgggatgacacaaccagagattggacttggagatcgtcatacagatgcacccttcatggctctatgcaaggagggctacatagtgccacctaagccagaggttgaagctgtaactactgacaagctcccaaaaccagtcatcttccatgatggccggctagtccaaaaaccaacaccattatcagcactactcacaattctctggatcccaataggcttcattttagcctgcttgagaattgcagccgggtcactcctgcctatgccaatggtctactatgctttctgggcacttggtgtccgtgtcatcataaagggaaccccacctcccccggccaagaaatcaatcggtcaatctggtgtcctctttatttgctctcaccgaaccttgcttgatccaatatttctctccactgccctcggccgtcctatcccagcagtcacgtactcagtttctcgtctctctgaaattatctcacccatcaaaactgttagactcagccgtgaccgtgctacagacgcatccatgatcaagaagttgttagaagaaggtgacctagctatatgccctgagggaactacttgccgcgaaccctttcttttaaggttctcagctttgtttgctgaattaacagaccaacttgttccagtggctgtggtgaatcgcatgagtatgtttcatgggacaacagcaagagggtggaaagggatggatccgttttacttcttcatgaaccctagcccagcatatgaagtaactttcttgaacaggttaccacaggagctaacctgcactggtgggaaatctagtcatgaggtggcaaactacatacaaagagtgattgctgccaccctgtcctatgaatgcacttcctttactaggagagataagtacagggcacttgctgggaacgatggtactgtggttgaaaaaacgaagctccaagccaacaaagtaatggggtgttga

SEQ ID NO: 125 - DNA, 1797 bp, Populus trichocarpa
acaacataactcacacttcctaagaactctcaaaataaacactatctatccctctccctctccctctctatccccctctgtgatggtcatgggggctcatcgccattttgaaccaatagcaaaatgtagcacagaggggcgatcgaatcagaccgtggctgcagacctagatggaacacttcttgtatcaagaagtgcttttccttacttcttgcttgttgctattgaagctgggagtctcctgagaggactaattcttttatcatcagtcccatttgtgtactttacgtacttaattatatcagaggaaatggcaatcaagaccttcatcttcattgccttcgctggacttaaaataagagacattgagcttgtttcaaggtctgtcttgccaaagttttatgctgatgatgtccatccagaaacttggagggtgttcaattcttttggaaagagatacattgttacagcaaatcctaggattatggtagagccatttgccaagaactttttaggtgctgacaaggttcttggcactgaaatacaggctacaaaatctggaagggcaactgggtttgtgaagaaacctggagttcttgttggagatcataagaggaatgctctcttaaaggagtttggtacaagtttgcctgatttaggcctgggagaccgcgaaactgaccatgacttcatgtccatctgcaaggaaggatatattgtgccaagatccaagtgcgagccactaccaagaaacaagcttctaagccctgtcatattccatgagggccggctggttcaaagacctactcccttggttgcccttctgacgttcttatggatgccaattggtattattctctccgtccttagggtctaccttaacatccctttgcctgagagaattgcctggtacaattataagctgctaggaattagagtagttgttaagggtaatcctccaccccctccaagaaaaggccaaagtggagtcctctttgtttgcaatcaccgtactgtcttagaccctgttgtcactgctgtcgccctaagaagaaaaattagctgtgtcacatacagcataagcaagttcactgagattatttcacctatcaaggctgttgctttatcaagggagagagacagagatgctgcaaatataaagcgtctacttgaagaaggtgacttggtaatttgcccggaaggaaccacttgtagagagccatttctcttgagatttagtgctctttttgcagaacttacagataggattgtgccagtcgctatcaatacaaaacaatctgtcttcaatggcacgacggttcgagggcacaaactgttggacccttattttgtgttcatgaatccaatgccaacatatgagatcaccttcttgaatcagctgcccacagagcttacttgcaaaggaggcaaatcatccattgaagttgcaaattacatacaaagggtgctggctgggacacttggatttgagtgcactaatttgactaggaaggacaagtacgctatccttgcaggaacagacggccgtgttgcaactaagaaggaaaaggcttcagaaaattaatctctccaaaaggcggcataaaagaaaatccatgatttaatttctctattgtttttttttatatataaaatattgctataacaataaaatttgacaatcgctattgtgattaattactataaaataactttagagtatatttgctttttttattttttaagtatgtataccgacatcaaattactctaatgcaatgtttatttaatcttcaa

SEQ ID NO: 126 - DNA, 1575 bp, Sorghum bicolor
atggagcgtcccagcccaacgtgcttagcggcgaacggcccacgtagaaaagcccgaacaatcccgttcccgccgcccccggctgatcttcgtacggggaggttgcggtcgcggcagacggtcgccgccgacctcgacggcacgctgctcctgtcccgaagcgcgttcccgtactacctcctcgtggcgctggaggccggcagcctcctccgcgccgtggcgcttctcatgtccgtgcccttcgtgtacctcacctacgtcaccgtgtccgagaccctggccgtgcgcgcgttcctctacgtcgccgtggcggggctcgacgtgagcgacatcgaggccgtcgcccggaccgtgctccccaggttctacgccggcgacgtccacccggagggctggcgcgtcttccgctcgttcgggaggaggtgcgtcgtcaccgccagcccgcgggtgatggtggagccgttcgccagggcgttccttggcgccgacgtggtcatcgggacggagatggaggtgggcgcgtccgggaaggccacggggttcgtcgccgggcccggggtgctcgtcggcgaacacaagaggcgggcggtggtgagggagttcggcgacgcgctgccggacgtcggcatgggggatcgcgagagcgacttcgacttcatggccatctgcaaggaagcgtacatggtaacacggcagaagtaccgcgcgttgccccgggagcagctgcagagccgggtcatcctccacgacggccgcctggcccggcgaccgacggcgaccaacacgcttctcactctcctgtggatgccgctcggcttcgcgctcgcgctggcgcgcgtgcatctccacctgctcctcccggcgcgcgccctctcctacgcctacaagcttatgggcgtcaagctggtggtgcgcggcaaccggccgccgccgccgccgccgtccaagaagggcggcggccccggggttctcttcgtgtgcaaccaccgcaccacgctcgaccctgtcgcggtggccgtcgcgctgggccgcaaggtgagatgggtcgtcacggacggcgcctccagcaggttctcggaggccgtgtcgcctgtcatgacaggcgtggcgctgcccgtgcccgtgcccagccgcgagagcgacgacgacgcggacgccgccgcccgcatccggcggctgctcgaggagggagacgacgtcgtcatcttccccgagggcaccatctgccgcgagcccttcctgctgcggttcggcgcgctcttcgctgaggtcaccgaccgcatcgtgcccgtggccatcggcgctagggagggcatgttccacgggtccacggcgcgcgggctcaggagaatggatccctacttctttttcatgaacccacggccgacgtacgaggtgacgttcctgaaccagcttccaagggagctcacctgcggcggcggaaggtcgccggtcgaggtggccaactatgtccaggaggtcctggccgcgcagcttggattcgactgcacttgcaccagcaagcaggcaaaaacaggatggtctccggcggccccgacggttgcgtggcgttga

SEQ ID NO: 127 - DNA, 1967 bp, Sorghum bicolor
gcctcccatatccatactcccccgcgcccgtcaccaccaacctcccgtcgcgtatattataactacacctcgccgccccactctccactgccaactcgcagcagcagtctctcctctgctcccacacactccttccccggggcctggcagtgagatcgagcctcgatccatcgagcactatagtagcaaagacacaagatggtggcgtcgtatcgcagtcgcaggttcaagcccatcgaggagtgctgctcggaggggcggtcggagcagacggtggccgccgacctggacggcacgctgctcatctcccggagcgcgttcccctactacctcctcgtggcgctcgaggccgggagcgtcctccgcgccgtgctgctgctcctgtccgtgcctttcgtctacgtcacctacatcttcttctccgagtcgctggccatcagcacgctcgtctacatctccgtcgcggggctcaaggtgcgcagcatcgagatggtggcgcgctccgtgctccccaggttctacgctggcgacgtgcacccggagagctggagggtgttcaactccttcggcaagcgctacatcatcaccgccagccccaggatcatggtcgagcccttcgccagggccttcctcggcgccgacaaggtcgtcgggaccgagctcgaggtcggcaagaacggcaaggccacggggttcatggtcaagcccggcgtgctcgtcggcgaccacaagaagaaggccgtcgtcaaggagctgggcgacgccgtgcccgacgtcggcatgggggatagggagaccgacttcgacttcatgtccatctgcaaggaggcgtacctggtgacgtcgaggaagtacagcccggtgggcaagaaccagctgctgagcccgctgatcctacacgacggtcgcctggtgcagcgcccgacgccgctcgtcgcgctcgtcaccttcctctggatgccgttcggcttcgcgctcgcgctcatgcgcgtgtacatcaacctgccgctgcccgagcgcatcgtctactacacctacaagctcatgggcatcaggctgatcgtcaagggcaacccgccgccgccgcccaagaagggccacccgggcgtcctcttcgtctgcaaccaccgcaccgtgctcgaccccgtcgaggtcgccgtggcgctgcgccgcaaggtcagctgcgtgacctacagcatctccaagttctccgagctcatctcgcccatcaaggccgtcgcgctgtcgcgggagcgagagaaggacgccgagaacatccgccgcctgctggaggaaggcgacctggtgatctgccccgagggcaccacctgccgcgagcccttcctgctgcggttcagcgcgctcttcgccgagctcaccgaccgcatcgtgccggtggcgatcaacaccaaggagagcatgttccacggctccaccgtgcgcgggttcaagctcatggacccttacttcttcttcatgaacccgcggccgacgtacgagatcacgttcctgacccagctccccaaggacctcacatgcagcggcggcaagtcgcccatcgaggtggccaactacatccagaagacgctcagcggacagcttggcttcgagtgcaccaccatcacgcgcaaggagaagtacggcatactcgctggaacggacggccgtgtcccgtccaagaacaaggacaaggagaaggagaagaactaacggccaacgtcgtcatcgctgctgcccgcccagcacactgccgttacgagtactgctgaaatttattccaattaattgttccttgtcgagaagttggccaattactcattgtttttaaaaggaccatgtgatgtgggccgtgtactagtacaagcttgatgatcatataattattatctacaagttcttcctcttcggaagaagggcaaaagtgttgttaggcccgtcttaatacaaagtttcgttgcatagtttcc

SEQ ID NO: 128 - DNA, 1518 bp, Sorghum bicolor
atggctgcctcgccgttccccacggtggagaagtgctcctccaccgaccggtccggcgacacggtggtggcggacctggacggcacgctgctgtgcggccggagctccttcccgtacttcgcgcacatggcgttcgagaccggcggcgtgctgcgcctgctgctgctcatcgcgctggcgccgctcgcgggcctcctctactacttcgtgtccgagccggcgggcatccaggtgctcatcttcgcgtccatggcgggggccagggtggccgacatcgaggccgtggcgcgggcggtgctgcccaagttctactgcgccgacctccacccggagtcgtggcgcgtcttctcggcgtgcggccgccggtgcgtgctcaccgcgaacccgcggatcatggtggaggcgttcctcaaggagtacgtcggcacggacgtcgtcgtcggcacggagctcgtcgtgtggcgaggccgcgcgacggggctggtgcgctccccgggcgtcctggtcggcgagcagaaggcggacgcgctccggaggacgttcggcgacgacgtcgcgcccgaggtcggcctcggcgacaggaagacggactacccgttcatgaggctgtgcaaggagggctacgtcgtgccggcgacgcccaagctgaagcccgtgccgcgcgagaacctgccgaagccggtggtcttccacgacgggcggctcgtccagaagccgtccccggcgctcgcgctgctcaccgtgctctggatcccgatcgggttcctgctcgcgtgcctgcgcatcgccgcgggcgcgctcctgccgatgcgcatggtgtaccacgcgttccgcgccctcggcgtccgtgtcaccatcaggggaaaccctccgccgccggcaagccgcgagacgggccagaccggcgtgctcttcatctgctcccaccgcaccctcctcgaccccatcttcctctccaccgccctgggccgccccatcaccgccgtcacctactcggtctcgcggctgtcggaaattctgtcgccaatccgcacggtgcgcctgacccgagaccgcgcggcggacgcggccatgatccggcggctcctgaccgagggagacctggtgatctgcccggaggggacgacgtgccgggagccgttcctgctgcgtttctcggcgctgttcgcggagctgacggacgagatcgtgccggtggcgatggagaaccagatgagcatgttccacgggacgacggcgcgagggtggaaagggctggaccctttctacttcttcatgaacccgagccccgggtacgtggtcacgttcctcaacaagctcccagcagagctcacctgcaatggcggcggcaagagcagccacgaggtggccaactacatccagcggctcatcgcgtccacgctgtcctacgagtgcaccaacttcacacggaaggacaagtacaaggcgctcgctggcaacgacggcaccgtcgtgtccaagcccaacattgacaagaacaaggtcatgggctgctag

SEQ ID NO: 129 - DNA, 1776 bp, Sorghum bicolor
gcagtgcgcagtgcgagagagagacagagtgagtgacagctccgatccgccgcacacgcgcgtgccacagcagatagcagcgagccatccatcccggcggccggcatggaggaggcggtggaggctgtggttgccgccggagtggagccgttcccgacggtggacaagtgcgacgcctcgggcctcggcgcgcactcctccgtggtggcggaccttgacggcacgctgctccggtcccgcagcgcgttcccgtactacgcgctggtggccttcgagaccggcggcgtgccacgcctgctcctcctcctgctcctctccccgctggccgccttgctgcgcttcctggcgtcggagtccgcgtgcctgcgcgtgctggtgttcggtgccacggcgggcgcccgtgtccgcgacgtcgagtccgcggcgcgcgccgtgctccccaggttctacgccgccgacgtgcacccggcggcctggcgcgtcttctccgcgtgctcccggaggcgcgtcgtgctcacggccacgcccaggctcttcgccgagccgttcctcagggactgcctcggcgccgacgccgtcgcgggcaccgagctcgccacgtggcgcggacgcgccacgggcttggtggacgcgcgcaggggcggcgtcctcgtcggcaggagcaaggcccaggcgctgcgggagatcttggccgccgacggcggcgacgcgcccgacgtcggactcggggacagccgctccgactaccccttcatgagcatgtgcaaggaggcgtacatcgtaccgcgcgcgccggtggagccggcattgcccatggaccagctgcctcgtccggtcatcttccacgacgggcgcctggtgcgccggccgacgccgctggtggcgctggtggtggtgctgtggttccccgtggggcttgcgctggcctgcctccgcatcgcggcgggggcgctgctgcccatgccgctggtgtactacgccttctgggcgctgggcgtgcgcgtcgtggtgcggggcgcgccgccgccgccgcgcgccgagcgcgccacggggcggaggggcgtcctcttcgcctgctcgcaccggacgctgctggaccccatcttcctgtccacggcgctgggccgccccgtcgccgccgtcacctactcgctctccaggctctccgagttcctgtcgcccatccggacggtgcgcctgtcgcgggaccgcgccacggacgccgccatgatcagggacctgctggcggagggagacctggtcatctgccccgaggggaccacgtgccgggagcccttcctgctgcgcttctcggcgctcttcgccgagctcaccagcgaggtggtgcccgtcgccatggagaacaggatgagcatgttccacggcaccaccgccagggggtggaaagggatggaccccttctacttcttcatgaacccgagcccggcctacgtcgtcaccttcctcaacaagctcccgccggagctcacctgcgccggcggcaggaccagccacgaggtggccaactacatccagaggctcatcgccgccacgctctcctacgagtgcacaagcctcaccaggaaggacaagtaccgggcgcttgcaggcaacgacggagtcgtcgccaccccaaagccgccgccaacggttgctagctagctagctaaggttattattattattattttttttaaaaaaaaagagagagaaagaaaattgggttattatattgtggtgatgatgctactgaattcattgtgattgttatgatgc

SEQ ID NO: 130 - DNA, 1744 bp, Ricinus communis
catttataacattttcagagagagagagagagagagtaatataaatatgccggcgatgaaacaggctcaaaagtttccgtcaataacatcatgcagcggcacctcatacgaatcaatagcagctgatctggatggtactctgctcgtctccagtagctcctttccttacttcatgctcgtggccgtggaagccggtagtctgttgcgtggtctagtgttgctgctttcgctgccttttatcatcatctcttatttcttcatatcagaagccatcgggatccaaatcctaatcttcatctctttcgctggtctcaaaatccgtgacatcgagcttgtttcccgcgctgttctgcctagattttatgctgcggatgtgaggaaagaaagctacgaggtgttcgataggtgcaagaggaaagtggtggtgacggcgaatccgacgattatggtggagccgtttgtgaaggattttcttggcggagacaaagttttgggaacggagattgaagtaaatcctaagacaaagagggccactggtttcgtgaagaagcctggcgtgttggttggcaaatggaagaagttggccattttgaaagagtttggagaggacgctcctgatcttgggatcggagaccgcaagactgatcatgacttcatgtccatttgcaaggagggctacatggtttatcacagcaaaaaagcagctactccactgccacgggatcgcctgaaaagtcctataatcttccacgatggccgttttgttcaacgaccggacccactcaatgccctcgctacctatctttggttgccatttggattcatgctctccatctttcgggtatacttcaatctaccactccccgaacgcatcgtacggtacacatacgagatgttaggcatccaccttgtgatccgtgggtacccacctccagcgccatcacgtggaacccctggaaatctatatgtgtgcaaccaccgtacagctttggatcctatcgtgattgcaatcgcactcggacgcaaagtttcgtgtgtaacatacagcgttagccgtctctcgagattcctatcaccaatcccagccatcgctttgacacgtgatcgtgcggctgacgcagaacgcatcacagctctactccaaaagggtgatcttgtagtgtgtcctgagggaactacatgtcgcgagcagtttttgttgagattcagtgcactgtttgctgaaatgagcgataggattgtgcctgtggcggttaattgcaagcaaagtatgttctatggcaccactgtacgtggggttaaattttgggacccttattttttctttatgaatccaaggccaacttatgaggtgacatttcttgatcggttacccgaagagatgacggttaaagcgggagggaaatcatcgattgaggtggctaattatgtgcagaaggttttgggtgatgtgttggggtttcagtgtactggattaacgaggaaggataagtacttgttgcttggagggaatgatggcaaggtggagtctatgtacaactccaaaaagtaagcatttggtttttcgtttctataagatttttagttacggatgtttgtaaggccagacatatcaaatattttagacattgatgtcgtcgtgctgaatttgcgcacagctttatatgcaagactcttttaagaatttggatgtccgatttcatggacgtgactggttaagatttcatgatgttataagggaatt

SEQ ID NO: 131 - DNA, 1539 bp, Ricinus communis
atggcaaaccctaaagaaacatatgctccttttagctcattcccaaatatagaaaagtgcacatccgtaggtcgacaaaacgacactgtagtgaccgatatggatggaaccctactttgtggacgtagcccgtttccttactttgccttagttgcctatgaagctagtggaatattaaggcttctattcttgctattaggttcgcctattgctggaattctccgctacttcatctccgaatctgctggaatccgagtacttgtatttgcaacctttgcagggatgcgagtgtctgatatagaatcggtggcaagagctgttttgcccaagttttattctagtgacttgcacccagagacttggcgggtgttctcttcgtgtgggaagaagtgcgtaatcacggaaaatcctaggattatggtagaggcattcttgaaagagtttgttggggctgatatggttattggcactgagattgttgtgcataaagggagagcgactgggtttattaggagtcccggtgttcttgttggacagaacaaggctgatgcgctaaaaatggctttctatgatgcgccggtgccaaatattgggatcggtgacaggaggactgatcgtccattcatgaaattgtgcaaggagagctacatagtcccaagcaattctcaagtagagccagttggtcctaaaaagttaccaaaacccatagttttccatgacgggcggcttgtccaaaaaccaacacatttaatcgcgcttgctactcttctttggattccagtaggctttattctcgcctgtctacgcttagccgccggtgcgctccttccaatgccattagtgtactacgccttgtgggcacttggtgttcgtattcacataaaaggcacaccaccgccgccagccaagaaatccactggccaagctggagtcctcttcgtatgttcccatagaactcttcttgacccggtcttcctctccatcgctttaggacgtccaatcccagccgtcacttactccctttcgcggctatcggagttcatttcacccatcaagactgtcaggctcactcgagaccgcgttactgatgcaaacatgatcaaggaactattacaagaaggtgacttagtcatatgtcctgaagggactacttgtagggaaccatttttgcttcggttttcagctttgttcgcggagttaaccgatgaacttgtccctgtcgccatggctaataagatgactatgtttcatggaacaacagctagaggatggaaagggatggaccccttctatttcttgatgaaccctagccctgcatatgaagtgacatttttgaacaagttgccttacaatttaacatgcggagcaggaaaatctagccatagtgttgctaattatatacaaaggacgattgctgcaactttgtcttaccaatgcaccagctttactaggaaggataaatatagagcacttgctggcaatgacggaactgtcgtggaggagcccaagcaggctcgtgatgaagtcatggattcctag

SEQ ID NO: 132 - DNA, 1515 bp, Ricinus communis
atggttatggtggacagcttcccagaagttagcaaatgtgcgtccaaaggccgagaaaagcacacggtggtcgctgatatggatggcaccctgtttattggtcgtagctccttcccttatttcgctctaattgccttcgaggctggtgggatttttaggcttcttttcttgctcttggcatcaccacttgcggcacttctttattactttgtttcagagtctgctggtattcaagttcttatctttgcatcctttgctggtatgaaagtatcggatattgaatctgtagcacgcgcagtgctgccaaagttctactccagcgatctccatcctgagtcatggcgtgtgttctcttcttgtgggaaacgctgcgttcttacagcgaacccaagaattatggtggaagcatttctgaaggatttcttgggagctgatttagtttttggtactgaaatatcaacttataaaggtagagctacaggttttgttcgtacccctggtgtacttgtaggcaagaacaaggcaaatgctcttaaaaaggcttttggagacgcaaggccagaagttgggcttggagataggcgcactgatgctccctttatggctttgtgcaaggagggatacctggtgccacccaagccggaagtcagggcagtaacaggtgacaagctcccaaaacccatcgtcttccatgatggcaggctagtccagaaaccaacaccattaatggcacttctcatcattctctggataccaataggcttcattctagcttgcttgagaattgcagcaggatcactcctgcctatgccaatggtctactatgccttcttagcactcggtgtccgtgtcacagtaaaaggcaacccacctcctccagccaagaaatcaactggtcaatcaggtgtcctctttgtttgctcccacagaactctccttgaccccatattcctctccactgcccttggccgccctattgccgcagtcacatactcagtatctcgcctctcggaaattatatcacccatcaaaacagttaggctcagccgcgatagagcaacagatgcagcaatgatcaagaagttgttagtagaaggtgacttagcgatatgtcctgaagggaccacttgcagggaaccctttcttttaaggttttcagctttgttcgcagaattaaccgatcaaattgtgccggtagctatggtgaacagaatgagcatgttccatggaactaccgctagagggtggaaagggatggatccattttacttcttcatgaaccctagtccagcttatgaagtaactttcttgagtaagttgccccaagaattaacgtgcagttcaggcaagtctagccacgaagtggctaattacatacaaagggtgattgctgctactctttcctatgaatgcactggatttactagaaaagataagtacagagcacttgctggcaacgatggcagtgttgttgagaaacctaagctcgaagccaacaaagtaatgggttgctaa

SEQ ID NO: 133 - DNA, 1804 bp, Arabidopsis lyrata
tttgtgctctctgttctttagagccgccattaacgagagagagagagagagagagagacttggcgagttataatgtctcccgcgaagaagagtggaaactttcctccgataacggaatgcagagacggagagtacgattcgatagccgccgatcttgacgggactctgcttctctcaagaagctcgttcccttacttcatgctggtcgccgttgaagctggaagccttttccgtggactaatactgcttctctcattaccaatcgtcattatttcttacctattcgtatccgaatctcttggaatccagatcctcatcttcatctccttcgctggtctcaaaatccgcgatatcgaactcgtctctcgcgcagttcttccacggttttatgcggcggatgtgaggaaagacagttttgatgtgtttgataagtgtaagaggaaagtggtagtgacggcgaatccgatagtgatggtggaggcgtttgtgaaggattatcttggaggtgataaagttttgggaacagagattgaagttaaccctaaatccaatagagccactggatttgtgaagaagcctggtgttcttgttggtgatcttaagaggttagccattttgaaagagtttggtgacgaatcacctgatctcggcctcggtgatcgaacctctgatcacgatttcatgtccctctgcaagaaaggttacatggttcatgcgtgcaagtcagccacaacaattccaaaagaacgtttaaagaaccgcatagtcttccacgacgggcgtttagcgcaacgtccaacgcccttaaacgccattgtcacatacctatggcttccctttggtttcatactctccatcattcgcgtctacttcaacctccctttacctgaacgctttgtccgttacacctacgagattctcggaattcacttaaccattcgtggccatcgtcctccacctccttcccccggaactcttggcaacctctatgtccttaaccaccgtaccgcgcttgatcccatcatcgttgctattgctcttggacgcaagatctgttgtgttacttacagtgtctctcgtctctcccttatgctttctcctattcctgctgttgccctcacccgtgaccgtgtcaccgatgctgccaacatgagaaaacttctcgagaaaggcgacttggtgatatgtccggaaggcacaacgtgcagagaagagtatctactgagatttagcgctctattctcagagctaagtgaccggattgtgccagtagcgatgaactgtaaacaaggaatgttcaacgggaccacagtgaggggtgtgaagttctgggacccttacttctttttcatgaacccaagaccaagctatgaagccactttcttggatcgtttgcctgaagaaatgactgtcaacggtggcggcaagactcctatagaggtggccaattacgtccagaaagttatcggcgcggtcttgggcttcgaatgcaccgaacttactcgcaaggataaatatcttttgcttggaggtaatgacggcaaggtggagtctatcatgttgggataaacttgaaataacttaagagataagttactaaaatgtaaaagagataaagctgaatattctaggagttatctagaataaatgtattaggagttttaattgatgatgtattggtacgttattgttatgttaattctatttttccctaaaactattttgtgatcacatttctatacgcatgtgcttaagggataataagaactttatatttaaagagcaaaattttattggaggaagt

SEQ ID NO: 134 - DNA, 1746 bp, Arabidopsis lyrata
atatccattctcaccttccaaatctctctcttctcttctctttccggcttcttcactaatgggagctcaggagaaacgacgtcgtttcgagcctatatcaaagtgcgacgttaaggaccggtccaaccataccgtggccgctgatctagacgggacactactgatctcacgtagcgccttcccttactatttcctcgtagccctcgaggcagggggcttgctccgagcattgatcctactcgtgtccgtaccgttcgtctatcttacgtacttgaccgtctcggagactttggccatcaacgtttttgtcttcatcacgtttgcgggtctcaagatccgagacgttgagctagtggtccgttccgtcctcccgaggttctatgcggaggacgtgaggcccgatacgtggcgtatctttaacacgtttgggaaacggtacatagtaacggcgagtcctcgaatcatggtcgagccgttcgtgaagacatacctaggagttgataaagttctcggaacagaactagaggtctccaaatcgggtcgggcaaccgggttcaccagaaaacccggtattctcgtgggtcagcacaaacgtgaagtcgttttgagagagtttggtagccttgcgtctgatttacctgatttggggctcggcgatagcaagacagactacgacttcatgtccatctgcaaggaaggttacatggtgccacgtacgaaatgcgaacccttaccaagaaacaaactcttaagccccataatattccacgagggcagattagtccaacgcccaacgccgttagttgctctgttaactctcctttggcttcccatcggtttcctcctctctcttatccgcgtctacacgaatattccgttaccggaacgtatcgcccgttacaactacaagctcactggcatcaagctaatcgtcaacggtcaccctcctccgccgccaaaacctggccaaccaggccatctcttggtttgtaaccaccgcaccgtccttgacccggtggtgacagccgtcgcgctcggccggaaaatcagctgcgtcacttatagcattagcaagttctctgagctaatctcaccaatcaaagccgttgcgttgactcgtcaacgtgagaaagacgcagcgaacatcaagcgccttttggaagaaggcgatcttgtgatctgtcccgagggaactacgtgccgtgagcctttccttctccggtttagtgccctcttcgctgagctcacggaccggattgttcccgtggcgatcaacacgaagcagagcatgttcaatggtactaccacacgtggctacaagcttcttgatccttacttcgcgttcatgaacccgaggccgacgtacgagatcacgttcctcaaacagattcccgctgagctgacgtgtaaaggaggcaaatcgccgatagaggtggcgaattacatacaaagggttttgggaggaaccttaggttttgagtgcaccaatttcacaagaaaggataagtacgcaatgcttgctggtaccgacggtagggttccggtgaagaaggagaagacgtgattattgatcggagaatggagaaaacgaagaaataatacaaagattggaatcttttttcatttggatggttaattatcaatatttaaggggcaaagaattgataagtttatttttttgttgtttcctttatcttctctgcttcgatgaatgtttcaagatttacttttagtacaataacggtt

SEQ ID NO: 135 - DNA, 1509 bp, Vernicia fordii
atgtcgcaaacgaaaccggctccaaaattcccttcaataacatcatgtaccggctcggcgtatcagtcaatagcggctgatcttgatggcacgctcctcgtgtccagtagctccttcccttacttcatgttagtggctgtcgaagctggtagtctcctccgtggtctggtgtcgcttctgtctctacctcttgtgatcatctcctattttttcatatctgaagccgtcggaatccaaatcctaatctatatctcctttgctgggctcaagatccgcgacatcgagctggtttcccgcgctgttttgcctaggttttatgctgctgatgtgaggaaggagagttttgaggtttttgacaaatgcaagaggaaggtggtggtgacggcaaatccgacgattatggtggagccatttgtgaaggattttcttggcggagacaaggtgttaggtacggagattgaagtaaatccaaagactaagagggccaccggattcgtgaagaatcctggcgtgttagtggggaaatggaagaaattgtccattttgaaagagtttggagaggaatcaccggatcttgggatcggagaccgcaagacggatcatgatttcatgtccatttgcaaggagggctacatggttcaacgcagcaaatcagctactccaataccactggatcgtctcaaaagtcgtataattttccatgatggccggttcgttcagcgacctgacccactgaacgctcttgtcacctatctttggctgccatttggattcatcctctctattattcgcgtatacttcaatctcccactcccagaacgcatcgtacggtacacatacgagatgctaggcatccaccttgtgatccgtgggaacccgcctcctgccccatcacctggaaccccaggaaatctctatgtttgcaaccaccgctcagctttggatcctattgtcattgcaatagcacttggacgcaaagtttcctgtgtaacatacagcgtaagccgtctctcgaggttcctatctccgattccagctatcgctttgactcgtgatcgtgccgctgatgcagcacgcatctcagagctactccaaaagggtgatcttgtagtgtgtccagaggggactacgtgtcgcgagccgttcctgttgcgattcagtgcattgttcgcagaaatgagcgataggattgtgccggtggcggttaactgtaagcaaaatatgttctatggtaccaccgtacgtggtgtcaagttttgggatccttattacttcttcatgaacccaagaccaacctatgaggtgacattccttgatcggttgccggaagagatgacagctaaggcgggagggaaatcgtcgatcgaggtggctaattatgtgcagaaggtgttgggtgatgtgttgggattcgaatgcactggattaactagaaaggataagtatatgttgctaggaggaaatgatggcaaggtggagtcaatgtacaacaccaaaaaagccggttaa

SEQ ID NO: 136 - DNA, 1545 bp, Oryza sativa
atgggggacgccacgatgatcgcgtcgccgttcccggcggtggagaagtgttcgtccaaggaccgcggcggcgacacgatcgtcgccgacctcgacggcacgctgctgtgcggccggagctcgttcccgtacttcgcgcacatggcgttcgagacggggggcgtcctccggctgctggcgctgatcctgctggcgccgctcgccggcgtgctctactacctggtgtccgagtcggccggcatccaggtgctcatcttcgcgtccatggccggcgcgagggtcgccgacgttgaggcggtggcgcgcgccgtgctgcccaagttctactgctccgacatccacccggagtcgtggcgcgtgttctcggcgtgcgggcgccggtgcgtgctcaccgcgaacccgaggatgatggtggaggcgttcttgaaggagtacctcggcgccgacatcgtcgtgggcacggagctcgtggtctggcgtggccgcgccacggggctcgtccggagccccggcgtgctcgtcggcgagaacaaggcggccgcgctccgggaggcgttcggcgacgcctcgccggagatcggcatcggcgaccggaggacggactacccgttcatgaggctatgcaaggaggggtacgtggtgccggtgtcgccgacgccgaggcccgtgccgcgggaggagctcccgaagccggtggtgttccacgacggccgcctggtccagaagccgtcgccggcgctcgcgctgctcaccgtgctctggatccccatcggcttcgtgctcgcctgcctccgcatcgccgccggcgcgctcctcccgatgcgcgtggtgtaccacgccttccgcgccctcggcgtgcgcgtcaccgtcaagggcaccccgccgccaccggccagccgcgagaccggccagtccggcgtgctcttcatctgctcccaccgcaccctcctcgaccccatcttcctctccaccgccctcggccgccccatcaccgccgtcacctactcggtgtcgcggctgtcggagatattgtcgccgatcaggacggtgcggctgacgcgggacagggcggcggacgcggcgatgatccggcggctgctggcggagggcgacctggtgatctgcccggaggggacgacgtgccgggagccgttcctcctccggttctcggcgctgttcgcggagctcaccgacgagatcgtgccggtggcgatggagaaccagatgagcatgttccacggcacgacggcgagggggtggaaggcgctggaccccttctacttcttcatgaaccctagccccggatacgtggtcaccttcctcagcaagctccccggcgagctcacctgcaacggcggtggcggcggcggcggcggccggagcagccacgaggtggccaactacatccagaggctcatcgcctccacgctctcctacgagtgcaccagcttcaccaggaaggacaagtacagggcgctcgccggcaacgacggcaccgtcgtgtccaagcccaacatcgacgagaagaaggccatgggatgttaa

SEQ ID NO: 137 - DNA, 1856 bp, Arabidopsis thaliana; identical to SEQ ID NO: 84

SEQ ID NO: 138 - DNA, 1503 bp, Populus trichocarpa
atgtcgccaacgaaacccgcaaaaaaatttccgccgataacggcctgtaacggcacgacgcaccaatctatagcagcggatcttgatggcacactccttgtgtcgagtagctcgtttccatactttatgattgttgctgttgaagctggaagcctctttcgtggtcttgttttacttctttcactgcctatcgtcatcgtgtcttacctcttcatatctgaagccttggggatacaaatgttaatcttcatttctatgtctgggctcaagatccgtgatattgaacttgtttcacgcgctgtattgcctaggttttatgctgcagatgttagatcggagagttttgaggtgtttgataggtgcaagagaaaggtggtggtgacagcaaatccaactataatggttgagccttttgtgaaggattttctcggtggagataaggttttgggcacggagattgaagtgaacccgaagaccaagagggctacaggatttgttaagaagcctggtgttctggtgggcaagtggaaagaattggctgttttaaaggagtttggagaggaagcaccggatcttggtattggtgaccgcaagactgatcatgatttcatgtccctttgcaaggagggctacatggtgcatcgcagcaaatcagcgactccactaccgcgggatcgcctcaaaaatcgtatcatcttccatgatggccgtcttgttcaacgtccagacccactcaatgccttgatcacttacatttggttgccgtttggattcatcctctccatcattcgcgtctacttcaacctcccactcccagaacgcatcgtacggtacacatacgaaatgcttggcattcacctggtcattcgtgggaccccacctcctgccccatcacctgggaccccaggaaatctctatgtttgcaatcaccgtacagccctggatccaattgtcatagccatagcacttggacgcaaagtctcgtgtgttacgtacagcgtaagccgtctctcgaggtttctttcaccaatcccagccatcgctttgactcgtgatcgcgcggctgatgctgcaagaatatcatccatacttcaaaagggtgatctagtggtgtgtccggagggaaccacttgtcgtgaggagttcttgctgcgatttagtgcattgtttgcagagttgagtgataggattgtgcccgtggcagtcaattgtaaacaaaacatgttttatggcacgaccgtgcgtggtgtcaagttctgggatccttattttttcttcatgaacccgaggccaacttacgaagtgacattccttgatcgcttgccagaggaaatgacggtcaaggctggtggcaaatcttcgatcgaggtggcaaactatgtgcagaaagtgttgggtgaagtgttaggattcgagaacactgggttgaccaggaaggacaagtacctgttgcttggtgggaatgatggtaaggtcgagtcaatgcacaatgccaaaaaataa

SEQ ID NO: 139 - DNA, 2117 bp, Sorghum bicolor
gccgagctcgactcggaatccgatcccccacccaactccatgctccgattcctcctcccttctctgctccgactccgaccaccaccacctctgctgccagccccgtcctacatataaatccctccgtcatcatcgtcaaccgcagcgttgggccgctcaacaaacgcagccaccgccgccgccgccaccacgacaccaaccatataatcgcctgcccaagtcccaaccttttccgacccagccagacaccaccaccaccgtcgtcttcctcgccatggcccccgcggcgagcgcgaggttcccaccggtgtcatcctacgacgcgtccgcacgcacccgccgaaccgccgccgcggacctggacggcacgctgctcgcgtcctcctcggcgttcccctactacttcctcgtggcgctcgaggccggctcgtgcctccgcgcggcggcgctcctcctcgtggctccgctcctgctagcgctctacacgctggtgtccgaggcggcggccatcgcgctgctggcgttcgtcacgttcgcggggctgcgcgtgcgcgacgtcgaggccgtcgcccgcggcgtcctgccgcggcactacgcggccggcgtgcgcgccgacacctggaccgtgttccgcggctgcggcgaggggaggagggtcgtcgtcaccgcgtcccccgccgtcatggtgggcgagttcgtacgcgagttccttggtgctgaggtcgctggcaccgagctcgagaccttctccgcgttcggcgccgccaggtttacggggaggatcaaggccgtgctcgtcggggagaggaaggcggaggtcgtccggcggctcttcgccggtggggagatgcccgacgtcgggcttggggaccgcgagagtgaccatgacttcatggccatctgcaaggaagcttacatggtgcctccggacaagcgcgcggcgcgtgcggccgccgacacgctgctgtcccgctccgtcttccacgacggccgcctcgtccagcgcccggacccggcgcaggcgctgttcgcgctggcctacctcccgctgggcttcctgctggcgctgttccgcgtcttcttcaacctcatgatgccgctacgcctggtccgccacacgtaccgcctgacggggatccgcctccgcgtccggggcacgccgccgccgcccccggcgccgggcgccccgggttcgctgctggtctgcaaccaccgcacggcgctggacccgatcatcctgtccgtggcgctgggtcgccccgtgtcgtgcgtcacgtacagcgcgagccgcctctcgacggcgatctcgccgatccgggccgtcgcgctgtcccgggaccgcgccaccgacgcggcgcgcatggcggcgctgctggcggagggcgacgtcgtcgtgtgccccgaggggaccacgtgccgggagccctgcctgctccggttctcggcgctgttcgccgagctcacggaccggatcgtgcccgtggccatggaggcgcggcagggcacctactacgggtcgacggcgagggggtggaagtggctcgacccctacttcttctacatgaacccgcggccaggctacgacgtcacgttcctgccgccgctgcggccggaggagacgtgcggcgccggcgggaggagcgccgtcgacgtggctaaccacgtgcagagggtcatcgccaaggagctcgggttccagtgcaccacgctcaccaggaaggacaagtacatgaagctcgccggcaacgacggctcggtcgccgccagggctaaaaaggacgccgccgatgataacgctgccacggtcaccaccaccaagaagtttgtatgaagagatcgattatatatattggcaacctagctcgactatatcggagcagcattgtactgacgtaaaaaaaaaaaaaacatgcatgcacaaaaggtctagttaggcttatgtatattggagtatcgtgttcttttatttatactacgtatacgtagaaagaatggacgagtgaatggagtccaattttaaaggcgcaatttatatatgattatgattattttgggtagtgtatttgcttaaaaatctaaacacatactaaattgcattgcaacaatttaaatttttt

SEQ ID NO: 140 - DNA, 1547 bp, Ricinus communis
acacatatttcccactgctactagcttcccaaaactcacaccttaatctatcaaattggtcatgggggctcatcggcatttcgagtcaatcaagaaatgcagcaccgagggacggtcgaatcagacggtggctgcagacctggacggcacacttcttgtttcatcaagtgcttttccatacttcttgctcgttgcacttgaagctggaagcgtgttaagagctatactccttttagcatctgttcctttcgtgtattttacgtacctggttttatcagaggcaatagctatcaaaaccttcatctttattgcctttgcaggacttaaaataagggacgttgagcttgtttcgcggtctgtcttgcctagattctacgcggatgatgtccatcctgaaacttggagagtgttcaattcttttgggaaaagatatattgtcaccgccagtcctaggattatggttgaaccttttgttaagacctttttaggtgctgacaaagttcttggcactgaactagaggttacaaaatcgggaaaggcaactgggttcgtcaagaaacctggaattcttgttgctgaacataaaagagatgccattttaaaagaactgggcgctgatttgccagatttaggcctgtggagaccgagaaactgaccacaatttcatgtctatttgcaaggaaggatatatggtgccaagaacaaagtgtgagccactaccaagaaacaagcttctaagccctgtaatattccatgaaggacggttagttcaaaggccaacacctctagttgccctcttgacctttttatggatgccaatcggtataattctctcaatccttagggtataccttaatatccctttacctgaaagaattgcctattacaattacaaaattcttggaattaaagttatagttaagggcacccctcctcctgctccaagaaaaggccaaagtggagtcctttttgtatgcaaccatcgtactgttttagacccagtagtgacagcagttgccttaggcagaaagatcagttgtgttacatatagcataagcaaattcacagaaatcatatcgccaatcaaagcagtcgcattatcaagagaaagagagaaagatgctgctaatattaagcgtttattagaagaaggtgacttggtcatttgccctgaaggaacaacttgtagagagccatttcttttgagatttagtgccctttttgctgaacttaccgacagaattgtgcctgttgctatcaataccaagcaaacagttttccacggcacgactgtccgagggcataaattattggacccttattttgtgttcatgaatccaatgccaacctatgagatcacattcttgaatcagttgcctatagagcttacttgcaaaggtggtaaatcgtcgatcgaagttgccaattacattcagagggttcttgctggtacattggggtttgaatgtactaatttgacaaggaaggacaagtatgctatccttgctggtacagacggtcgtgttccatctaagaaggaaaagtaa

SEQ ID NO: 141 - DNA, 1549 bp, Arabidopsis lyrata
aagattcgccgcaagaaaacatgtctccggcgaagaagagccgaagttttcctccgataagcgagtgtaaaagcagagagtatgattcgatcgctgcggatctcgacggcactctgcttctctcaagaagctctttcccttacttcatgctcgtcgccattgaagcaggtagtctcttccgtggattgatccttcttctttctcttcccatcgtcatcatcgcttatctcttcgtctccgaatctctcggaatccaaatccttatctacatctccttcgccggtatcaaaatcaagaacatcgaactcgtctctcgcgccgttcttccacggttttacgcggcggatgtgaggaaagatagttttgaggtgtttgataaatgcaagaggaaagtggtggttactgcgaatccgatagtgatggttgagccattcgtcaaagattatttgggaggagaaaaagttttgggaacagagattgaagttaaccccaaaacgatgaaagctactggttttgttaaaaagcctggtgttcttgttggtgatttgaagagattagccatcttgaaagagttcggcgaagaatcaccggatattggactcggtgaccggacctccgatcacgatttcatgtccatttgcaaggaaggttacatggtgcatgagaccaaatcagccacaacagtccctatagagcgtctcaagaaccgcataatcttccacgatggccgtcttgtccaacgtccgacgccgttgaacgccttaatcatttacctttggcttcctttcggctttatgctctctatcttccgcgtctacttcaacctccctttacccgaacgcttcgttcgctacacttacgagatcctcggcattcacctcacaatccgtggccaccgtcctccccctccttcccccggcaaacctggaaacctttacgtccttaaccaccgaaccgcccttgaccccataattatcgccattgctctcggccgtaagatcacatgtgtcacttatagtgtctctcgcctctccctgatgctctcacccattcctgctgttgctctgacccgagaccgtgtcgctgatgcagcccgcatgagacaactcctcgagaaaggtgatttggtgatctgtcctgaaggcacaacgtgtagagaaccatatctactaagattcagtgctctatttgcggagctgagcgaccggatcgtgcctgtggccatgaactgcaagcaagggatgttcaacgggacgacagttagaggtgtgaaattctgggatccgtacttcttcttcatgaaccctcgacctagctacgaggccactttcttggaccgtttgcccgaagaaatgacggtaaacggtggtggcaagactccttttgaggtggctaattacgttcagaaggtgatcggtggagttttggggttcgaatgcactgaacttacaaggaaggataagtatctgttgcttggaggcaacgacggaaaggttgagtctatcaataagaccaagtccatggactaataatctagctagttactggt

SEQ ID NO: 142 - DNA, 1995 bp, Arabidopsis thaliana
ccaacacatttacttttcttcttcttctctctctacgccatagctatggttttaccagagcttctcgtgattctagcagaatgggttctttaccgtcttcttgctaaatcatgttacagagctgctagaaagctcagaggctatggtttccagttaaaaaatctcctaagcctctccaaaacacaatctctacacaacaattctcagcatcatcttcataaccatcatcaacaaaatcaccctaaccaaacccttcaagattctctagaccctctgttcccaagccttacaaaataccaagaacttcttctagacaaaaacagagcatgctctgtttcgtctgatcattatcgtgatacctttttctgcgatatcgatggtgttttattaagacaacattcgagcaaacacttccacacgttcttcccttacttcatgctcgtggcttttgaaggaggatcgatcatcagagcgatccttctcttgctctcctgttctttcctttggactctgcaacaagaaaccaaactcagagttctctctttcataaccttctctggtcttagagtcaaagacatggacaatgtttctagatcggttctaccaaaattcttcctcgagaacttgaatatccaagtttacgacatctgggctcgaactgagtactccaaagttgtgttcacgagcttgccgcaagtgctggtggagaggttcctcagagaacatctcaacgctgatgatgtgattgggactaaactgcaagaaataaaagtcatgggaaggaaattctacacaggcctagcttctggttctggtttcgtcctgaaacataaatcagctgaagactacttttttgatagcaagaagaagcctgcacttggaattggaagctcttcaagcccacaagatcacatcttcatctccatttgcaaagaagcttatttttggaatgaagaagagtccatgagcaagaacaacgcattgcctagagaaagatacccaaagccactgatattccacgacgggagattggctttcttgccaacaccattagctacattagccatgttcatatggctccctatcggatttttactcgctgtcttcaggatctcggtaggagtctttcttccttaccatgtagccaatttcttggcttctatgtccggtgttaggatcactttcaagacccataatttgaataacggtcgtccagagaaaggtaatagtggagtcttgtatgtatgcaaccataggaccctcctcgacccagttttcctcaccacttcgctgggcaagcccttgaccgcggttacttacagcctaagcaagttctccgagttcatagcacctctcaagacggttagccttaaaagagataggaagaaagacggtgaggcaatgcagagactattaagcaaaggagatctagtggtttgtccggagggaaccacatgtagagagccttatctactaaggttcagtcctttgttcgctgagttaactgaagacattgttcccgtggctgtagatgctcgagtgagcatgttctatgggacaactgcgagcgggctcaagtgtttagaccctatcttcttcctcatgaaccctaggccggtttattgtcttgagattttaaagaagttgccaaaagagatgacttgtgcaggaggcaagtcaagctttgaagttgcgaatttcatacagggagaacttgctagggttttgggatttgaatgcactaatctcacaaggagggataagtacttggttcttgctggaaatgaaggcattgtcagataaactattccgaattttcattagtttttttgtttgtttgaaaagctaaatattattgttatttcaggacttagatgtttaattctatatggttgattcattggcatcatttctatttcttatcactcgggaccattgatatgtattgaaaatgtttgctttatatgattttgtttctggatttgtatagtccat

SEQ ID NO: 143 - DNA, 1828 bp, Arabidopsis thaliana
gtctgaaaccaaacaaagaaaatacacgaaggaaggaaaagaaaagtaaaaagaaaagctttctgcaaaatccaaacatgtccgccaagatttcaatattccaagctcttgtctttctattctaccggtttatcctccggcgatatcggaactctaaaccaaaataccaaaatggcccttcttctctcctccaatccgacctatcacgccacacattgatcttcaacgtagaaggagctcttctcaaatccgactctctcttcccttacttcatgttagtagcatttgaggcgggaggcgtaataaggtcatttctcctcttcattctctatccattgataagcttgatgagccatgagatgggtgtcaaagtgatggtaatggtgagcttcttcgggatcaaaaaagaaggttttcgagcggggagagcggttttgcctaaatactttctagaagatgtcggactcgagatgttcgaagtgttgaagagaggagggaagaaaatcggagtgagtgatgatcttcctcaagttatgatcgaagggttcttgagagattacttggagattgacgttgtggtcgggagagaaatgaaagtcgttggaggttattatctaggtatcatggaggataaaaccaaacatgatcttgtctttgatgagttagttcgtaaagagagactaaacaccggtcgtgttattggcatcacttccttcaatacatctcttcaccgatatctattctctcagttttgccaggaaatttatttcgtgaagaaatcagacaagcgaagctggcaaaccctaccacgaagccagtaccctaaaccattgattttccatgatggccgtctcgcgatcaaaccaaccctaatgaacactttggtcttgttcatgtggggtcctttcgcagccgcagccgcagcagccagactcttcgtctctctttgcatcccttactctttatcaatcccgatcctcgccttttccggttgcagactaaccgtcactaacgactacgtttcatctcaaaaacaaaaaccaagtcaacgcaaaggttgtctctttgtttgtaaccataggactttattggaccctctctatgttgcattcgctttgagaaagaaaaacatcaaaactgtaacgtatagtttgagtagggtatctgagattttggctccgatcaagacggtgagactgacccgtgatcgggtgagcgacggtcaagccatggagaaattgttaaccgaaggagatctcgttgtttgtcctgaaggaaccacttgtagagaaccttacctgcttaggtttagccctttgttcaccgaggttagtgatgtcatcgttcccgtggctgtgacggtacacgtgaccttcttctacggtacaacggcgagtggtcttaaggcacttgacccgcttttcttcctcttggatccttatcctacctacaccatccaatttctcgaccctgtctccggtgccacgtgccaagatcctgatggaaagttgaagtttgaggtggccaacaatgttcagagtgatattgggaaggcgttggatttcgagtgcacaagtctcactagaaaagacaagtatttgatcttggccggtaataatggagtagttaagaaaaattaaaatttgttttaggatgatgagtgagtgatgagttcggttctttgggtatgtaagtaaccaatcgattatttcatttgtttattaataatgtctacgtaaatgtaactacaatctttttttcttggtaatgtacacatatgttctatatcatatccaaaatctttgtcagacaattttgcctttcatgc

SEQ ID NO: 144 - protein, 503 aa, Arabidopsis thaliana
MSPAKKSRSFPPISECKSREYDSIAADLDGTLLLSRSSFPYFMLVAIEAGSLFRGLILLLSLPIVIIAYLFVSESLGIQILIFISFAGIKIKNIELVSRAVLTRFYAADVRKDSFEVFDKCKKRKVVVTANPIVMVEPFVKDYLGGDKVLGTEIEVNPKTMKATGFVKKPGVLVGDLKRLAILKEFGDDSPDLGLGDRTSDHDFMSICKEGYMVHETKSATTVPIESLKNRIIFHDGRLVQRPTPLNALIIYLWLPFGFMLSVFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSME

SEQ ID NO: 145 - protein, 501 aa, Arabidopsis thaliana [sequence omitted]

SEQ ID NO: 146 - protein, 289 aa, Arabidopsis thaliana
MVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRFSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 147 - protein, 503 aa, Arabidopsis thaliana
MSPAKKSRSFPPISECKSREYDSIAADLDGTLLLSRSSFPYFMLVAIEAGSLFRGLILLLSLPIVIIAYLFVSESLGIQILIFISFAGIKIKNIELVSRAVLTRFYAADVRKDSFEVFDKCKKRKVVVTANPIVMVEPFVKDYLGGDKVLGTEIEVNPKTMKATGFVKKPGVLVGDLKRLAILKEFGDDSPDLGLGDRTSDHDFKSICKEGYMVHETKSATTVPIESLKNRIIFHDGRLVQRPTPLNALIIYLWLPFGFMLSVFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSME

SEQ ID NO: 148 - protein, 467 aa, Oryza sativa
MAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 149 - protein, 512 aa, Picea sitchensis
MAKGQSGLDCQGLFDVISKCSSKGRENQTVAADLDGTMLRSRSSFPYFMLVAMEGGSLLRGMVLLACAPMAWFLYNFISEAAGIQLLIFISFAGLKIRDIELVSRAVLPKFYAEDVHPESWRVFSAFGKRYIVTANPRIMVEPFVKGYLGADKVLGTELQVSRSGRATGFVKKPGVLVGDLKKAAVEAEFGDKLPELGLGDRETDHPFMSLCKEGYMVPKMKVDEVPTNKLMSPIVFHDGRLVQRPNPGAALLTFLWLPIGFFLAQFRVFGNIPIPEKYVKISYKIMGIKLVVKGTPPPAPKKKGERGVLFVCDHRTLLDPVIVAVALGRKVSAVTYSISRFSEIISPIKTVRLTRDRERDAANIKRLLEEGDLVICPEGTTCREPFLLRFSALFAELTDRIVPVAICNKMSMFHGTTVRGWKGFDPFFFFMNPVPTYEVTFLDQLPTELTCAGGKSPIEVANYIQRVLAATLGYECTNFTRKDKYRMLAGNDGIVSLNKTATARSNNHKQN

SEQ ID NO: 150 - protein, 502 aa, Zea mays
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTELEVGRDGKATGFMARPGVLVGDHKKKAVVKELGDALPDVGMGDRETDFDFMSICKEAYLVTSRKYSPVPRNQLLSPLIVHDGRLVQRPTPLVALVTFLWMPFGFALALMRVYINLPLPERIVYYTYKLMGIRLVVKGTPPPPPKKGHPGVLFVCNHRTVLDPVEVAVALRRKVSCVTYSISKFSELISPIKAVALSRERDKDAENIRRLLEEGDLVICPEGTTCREPFLLRFSALFAELTDRIVPVAINTKETMFHGSTVRGFKLMDPYFFFMNPRPTYEITFLTQLPKDLTCSGGKSPIEVANYIQKTLSGQLGFECTSITRKEKYGMLAGTDGRVPSKNKEKEKEKDKN

SEQ ID NO: 151 - protein, 500 aa, Arabidopsis thaliana
MSPEKKSQNFPPITECRDGEYDSIAADLDGTLLLSRSSFPYFMLVAVEAGSLLRGLILLLSLPFVIISYLFVSESLGIQILIFISFAGLKIRDIELVSRAVLPRFYAADVRKDSFEVFDKCKRKVVVTANPIVMVEAFVKDYLGGDKVLGTEIEVNPKTNRATGFVKKPGVLVGDLKRLAILKEFGNESPDLGLGDRTSDHDFMSLCKKGYMVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRSSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 152 - protein, 486 aa, Oryza sativa
MSPFKPIEQCSTEGRSQQTVASDLDGTLLLSRSAFPYYLLVALEAGGPLRAVALLMSVPFVYLTYVTISESLAVRALLYIAVAGLEVRDVESVARSVLPRFYAGDVHPEGWRVFSSFGRRCVVTASPRVMVEPFARAFLGADRVIGTELEVGEDGRATGFVAKPGVLIREHKRNAVVREFGDALPDVGMGDRESDFDFMAICKDAYVVTTSRKHRPVPESQLLRTVVLHDGRLAQRPTAINTLLVFLWMPVGFALALLRACLSLLLPERVLSYAYKLTGVGLVVRGRPPPPDGSPGVLFVCNHRTVLDQVAVAAALGRKVICVTYSVPRKTYGMSSRLPEALTASPVKAAVALCRERDRDADRVRRLLEEGVDIVAFPEGTTCRGAFLLRFSSLFAELTDRIVPVAIATRETMFHGSTARGFKGMDPYFFFMNPRPAYEVTFLSQLPSELTSGGGGKSPVEVANYVQKALAGQLGSEHIGITRKEK

SEQ ID NO: 153 - protein, 506 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRADTWAVFHGCAERRVVVTASPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGAPPPPPRPGTPGSLLVCNHRTALDPIIVSIALGRPVTCVTYSVSRLSTAISPIRAAALTPDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 154 - protein, 486 aa, Oryza sativa
MSPFKPIKQCSTEGRSQQTVASDLDGTLLLSRSAFPYYLLVALEAGGPLRAVALLMSVPFVYLTYVTISESLAVRALLYIAVAGLEVRDVESVARSVLPRFYAGDVHPEGWRVFSSFGRRCVVTASPRVMVEPFARAFLGADRVIGTELEVGEDGRATGFVAKPGVLIREHKRNAVVREFGDALPDVGMGDRESDFDFMAICKDAYVVTTSRKHRPVPESQLLRTVVLHDGRLAQRPTAINTLLVFLWMPVGFALALLRACLSLLLPERVLSYAYKLTGVGLVVRGRPPPPDGSPGVLFVCNHRTVLDPVAVAAALGRKVICVTYSVPRKTYGMSSRLPEALTASPVKAAVALCRERDRDADRVRRLLEEGVDIVAFPEGTTCRGAFLLRFSSLFAELTDRIVPVAIATRETMFHGSTARGFKGMDPYFFFMNPRPAYEVTFLSQLPSELTSGGGGKSPVEVANYVQKALAGQLGSEHIGITRKEK

SEQ ID NO: 155 - protein, 507 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRAETWAVFHGWAKRRVLVTALPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGARRRPLRPGDAGAPSCCATTEPPRTPSSCPSALAAPLRALRTALAPLSTAISPIRAAALTRDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 156 - protein, 497 aa, Oryza sativa
MVSRRFKPVEECSSDGRSEQTVAADFDGTLVRSRSAFPYYLLVALEAGSVLRAVVLLLSVPFVYVTYIFFSESLAISTLVYISVAGLKVRNIEMVARSVLPKFYAEDVHPESWRVFNSFGKRYIITASPRIMVEHFAKTFLGADKVVGTELEVGKNGKATGFMVKPGVLVGDHKRQAVVKELRDAVPDVGLGDRETDFDFMSICKEAYLVTSRKYSAVPKNQLLSPLILHDGRLVQRPTPLVALVTFLWMPFGFVLALLRVYVNLPLPERIVFYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLNQLPKELTCSGGKSPIEVANYIQKTLSGQLGFECTAITRKEKYSILAGTDGRVPSKNKEKEKN

SEQ ID NO: 157 - protein, 505 aa, Oryza sativa
MIASPFPAVEKCSSKDRGGDTIVADLDGTLLCGRSSFPYFAHMAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGRSSHEVANYIQRLIASTLSYECTSFTRKDKYRALAGNDGTVVSKPNIDEKKAMGC

SEQ ID NO: 158 - protein, 474 aa, Oryza sativa
MGDPPMIASPFPAVEKFSSKDRGGDTIVPDLDGTLLCGRSSFPYFGHMAFKTGGVLRLLALILLAPFAGLLYYLVSDSAGIQVLIFASMAGPRVPDFKAAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 159 - protein, 497 aa, Selaginella moellendorffii
MADLKYSRLVQFGLVENCSSEGRGMHTVAADLDGTLLRRRSSFPYFLLVALEGGSLFRAVVLGLLAPIAWLLYHFVSEAAAIQLLIYVSFSGQKVSEIEKVATAVLPKFYSQDVHSDAFRVFSSCGKKYVITANPRIMVEYFCKAFLGADKVIGTEIEVDDDGRATGFVKFPGVLVSQNKRTALKLEFVDGELPEIGLGDRETDFAFMSLCKEAYVVPKRKVDAVDGSALAQRVIFHDGRLVQLPTPFVALVTFLWLPIGFALAVLRIGLTSRCPRKYMGMIYAILGVRRITKGKVPRKQDGRGLLFVCNHRTLVDPIFLGLAAERDVTGLTYSISRVSEVLSPIVTVRLTRDKERDFTKMKSLLERGRDLCLCPEGTTCREPFLLRFSALFTQLTHRIVPAAVKTRQSMFNGTAVRGWKGMDPFFFFMNPFPTYEVEFLEELPAEMSVQKGGKSSFETANFIQKMLGDKLGYECTTFTRKDKYLMLNGSDGTVPTK

SEQ ID NO: 160 - protein, 534 aa, Selaginella moellendorffii
MSLDGGKVTDSFLVDAPFEPVERCSSAGREKQTCVADFDGTLIRGRSSFPYFMLVALEGGGLIRSVILGLFAPLAWILYHFVSESAGIRLLIFISFAGMKAKQIESVSRAVLPKFYSEDVHSEAYRVFSSCGKRVVVTANPRIMVEHFAKTCLGADKVLGTEIEVTRSGYATGFLKRPGVLVGVNKRKAVRQEFGEHLPHVGIGDRATDFAFMALCKEAYVVPPSKVEALSRDKLVKPVVFHDGRLVQRPTPLTALVTFLWLPVSFVLAVFRIMVTVPCPREYVTIVYKLVGIRLIVKGPIPPPKKRGESGVLFVSSHRTLCDPVFVGVGARREVTALTYSISRVSEFLSPIKTVGLSRDRERDAAKIKALLQKGDLCICPEGTTCREPFLLRFSALFAELTDKIVPVALCTKGSTFHGTTVRGWKGLDPFFFFMNPFPTYEVTFLQQLPPELTVQQGGKSAIEVANHIQRVIADTLGFECTNFTRKDKYGMLAGNDGTVPERRRSGGGGGGAAKDLPKDEQAAQGQDQVNGCS

SEQ ID NO: 161 - protein, 494 aa, Selaginella moellendorffii
MAEFPPIEKCGTTISRESESVASDLDGTLLRGRSSFPYFFLTTFETSGILRSWLLLLVSPLVWLLYHFISEAAGIKLLIFASLAGVPVSQIECIARSVLPRFYLQDLNPETWKVFSSFGKKIVVTANPRILVESLCKEFLGADEVIGTELEVDNRGRATGFVKSPGVLVGENKAKALLQACDPEQLPDVGLGDRQTDFPFMKLCKEGYVVPPSNNVEPVPKSQLLKPIIFHDGRLVQLPTPLVALVTLLWIPVGFVLACLRIAAGSLLPMSIVYHAFWLLGVRVTVKGTPPPRATKNSRGVLFICSHRTLLDPIFLSCALGRGVSAVTYSVSRLSEILSPIKTVALSRNRYKDAAQIRELLKEGDLVICPEGTTCREPFLLRFSALFAELADDIVPVAMDNRMSMFHGTAARAWKGMDPFYFFMNPSPSYEVTFLQQLPEELTCKGGKSSHEVANHIQRALAGVLDFECTNLTRKDKYKALVGTDGSVETKKST

SEQ ID NO: 162 - protein, 494 aa, Selaginella moellendorffii
MAEFPPIEKCSSTISRESESVASDLDGTLLRGRSSFPYFFLTTFETSGILRSWLLLLVSPLVWLLYHFISEAAGIKLLIFASLAGVPVSQIECIARSVLPRFYLQDLNPETWKVFSSFGKKIVVTANPRILVESLCKEFLGADEVIGTELEMDSRGRATGFVKSPGVLVGENKAKALLQACDPEQLPDVGLGDRQTDFPFMKLCKEGYVVPPSNNVEPVPKSQLLKPIIFHDGRLVQLPTPLVALVTLLWIPVGFVLACLRIAAGSLLPMSIVYHAFWLLGVRVTVKGTPPPRATKNSRGVLFICSHRTLLDPIFLSCALGRGVSAVTYSVSRLSEILSPIKTVALSRNRDKDAAQIRELLKEGDLVICPEGTTCREPFLLRFSALFAELADDIVPVAMDNRMSMFHGTAARAWKGMDPFYFFMNPSPSYEVTFLQQLPEELTCKGGKSSHEVANHIQRALAGVLDFECTNLTRKDKYKALVGTDGSVESKKST

SEQ ID NO: 163 - protein, 490 aa, Selaginella moellendorffii
MEHPYDVIDNCSADNREKQSVVADLDGSCVRSRSSFPYFMLVALEGGSLLRSVLLMVMAPVAWLLYHFVSEAAGIKVLIFFSCAGQRARDIEAVARAVLPKFYSEDVHSSTWRVFSSCGKRYILTASPRLMVEHFATTYLGADKVIGTELQVTRSGYATGFVKSPGVLVGVNKRRALKAVFGEEVPDLGIGDRSSDYPFMAFCKEAYIVPSQPADAVPAHKLARKIIFHDGRLVQRPTPFVALVTFLWLPAGFLLAFFRILVALPCPVEYVPLLYKVIGVRLIVKGKVPPPSKNGILFVCTHRTLIDPIMASAASGSDVTALTYSISRVSEVLSPIKTVPLSRDRERDASNIKRLLLKENLAICPEGTTCREPFLLRFSALFAELSENIVPVATSTKTSIFHGTTVRGWKGMDPFFFFMNPFPVYEVTFLERLPHDLSVQGGKSAIEVANYIQRVLADTLGFECTNFTRKDKYGMLIGSDGTVPARKKSF

SEQ ID NO: 164 - protein, 497 aa, Selaginella moellendorffii
MADLKYSRLFRFGLVENCSSEGRGMHTVAADLDGTLLRGRSSFPYFLLVALEGGSLFRAVVLGLLAPIAWLLYHFVSEAAAIQLLIYVSFSGQKVSEIEKVATAVLPKFYSQDVHSDAFRVFSSCGKKYVITANPRIMVEYFCKAFLGADKVIGTEIEVDDDGRATGFVKFPGVLVSQNKRTALKLEFVDGELPEIGLGDRETDFAFMSLCKEAYVVPKRKVDAVDGSALAQRVIFHDGRLVQLPTPFVALVTFLWLPIGFALAVLRIGLTSRCPRKYMGMIYAILGVRRITKGKVPRKQDGRGLLFVCNHRTLVDPIFVGLAAERDVTGLTYSISRVSEVLSPIVTVRLTRDKQRDFTKMKSLLERGRDLCLCPEGTTCREPFLLRFSALFTELTHRIVPAAVKTRQSMFNGTAVRGWKGMDPFFFFMNPFPTYEVEFLEELPVEMSVQKGGKSSFETANFIQKMLGDKLGYECTTFTRKDKYLMLNGSDGTVPTK

SEQ ID NO: 165 - protein, 534 aa, Selaginella moellendorffii
MSLDGGKVTDSFLVDAPFEPVERCSSAGREKQTCVADFDGTLIRGRSSFPYFMLVALEGGGLIRSVILGLFAPLAWILYHFVSESAGIRLLIFISFAGMKAKQIESVSRAVLPKFYSEDVHSEAYRVFSSCGKRVVVTANPRIMVEHFAKTCLGADKVLGTEIEVTRSGYATGFLKRPGVLVGVNKRKAVRQEFGEHLPHVGIGDRATDFAFMALCKEAYVVPPSKVEALSRDKLVKPVVFHDGRLVQRPTPLTALVTFLWLPVSFVLAVFRIMVTVPCPREYVTIVYKLVGIRLIVKGPIPPPKKRGESGVLFVSSHRTLCDPVFVGVGARREVTALTYSISRVSEFLSPIKTVGLSRDRERDAAKIKALLQKGDLCICPEGTTCREPFLLRFSALFAELTDKIVPVALCTKGSTFHGTTVRGWKGLDPFFFFMNPFPTYEVTFLQQLPPELTVQQGGKSAIEVANHIQRVIADTLGFECTNFTRKDKYGMLAGNDGTVPERRRSGGGGGGAAKDLPEDEQAAQGQDQVNGCS

SEQ ID NO: 166 - protein, 497 aa, Oryza sativa
MVSRRFKPVEECSSDGRSEQTVAADFDGTLVRSRSAFPYYLLVALEAGSVLRAVVLLLSVPFVYVTYIFFSESLAISTLVYISVAGLKVRNIEMVARSVLPKFYAEDVHPESWRVFNSFGKRYIITASPRIMVEHFAKTFLGADKVVGTELEVGKNGKATGFMVKPGVLVGDHKRQAVVKELRDAVPDVGLGDRETDFDFMSICKEAYLVTSRKYSAVPKNQLLSPLILHDGRLVQRPTPLVALVTFLWMPFGFALALLRVYVNLPLPERIVFYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLNQLPKELTCSGGKSPIEVANYIQKTLSGQLGFECTAITRKEKYSILAGTDGRVPSKNKEKEKN

SEQ ID NO: 167 - protein, 506 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRADTWAVFHGCAERRVVVTASPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGAPPPPPRPGTPGSLLVCNHRTALDPIIVSIALGRPVTCVTYSVSRLSTAISPIRAAALTRDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 168 - protein, 515 aa, Zea mays
MAARFPPVSSYDASARVRRTAAADLDGTLLASSSAFPYYFLVALEAGSCARALLLLLAAPLLLALYTLVSEAAAIALLAFVTFAGLRVRDVEAVARGVLPRHYAAGVRADTWAVFRDCGAARRVVVTASPAVMVADFVREFLGAELAATELETCRALGDAWFTGRIKAVLVGERKAEVVRRLFAAGDLPDVGLGDRESDHDFMAICKEAYMVPPDRRAPRAAADALLSRAVFHDGRLVRRPDPAHALFALAYLPLGFLLALFRVLFNLAMPARLVRHTYRLTGIRLRVRGTPPPAPAPGAPGSLLVCNHRTALDPIIVSVALGRPVACVTYSVSRLSTAVSPVRAVALSRDRAADAARIAALLAEGDVVVCPEGTTCREPCLLRFSALFAELTDRIVPVALDARQGTYYGSTARGWKWLDPYFFYMNPRPGYDVTFLPPLRPEETCGAGGRSAVDVANHVQTLIAKELGFRCTKLTRKDKYMKLAGNDGTVGGRPENEKGAADDSAATATTKKLV

SEQ ID NO: 169 - protein, 500 aa, Zea mays
  misc_feature (92)..(92): Xaa can be any naturally occurring amino acid
MVASPRFKPIEECCSEGRSEQTVAADLDGTLLISRSAFPYYLLVALEAGSVLRAALLLLSVPFVYVTYAFFSESLAISTLVYISVAGLKVRXIEMVARSVLPRFYAGDVHPESWRVFSSFGRRYVVTASPRVMVEPFARAFLGADKVVGTELEVGRDGKATGFMARPGVLVGDHKKKAVVKELGDALPDVGMGDRETDFDFMSICKEAYLVTSRKYSPVPRNQLLSPLIVHDGRLVQRPTPLVALVTFLWMPFGFALALMRVYINLPLPERIVYYTYKLMGIRLVVKGTPPPPPKKGHPGVLFVCNHRTVLDPVEVAVALRRKVSCVTYSISKFSELISPIKAVALSRERDKDAENIRRLLEEGDLVICPEGTTCREPFLLRFSALFAELTDRIVPVAINTKETMFHGSTVRGFKLMDPYFFFMNPRPTYEITFLTQLPKDLTCSGGKSPIEVANYIQKTLSGQLGFECTSITRKEKYGMLAGTDGRVPSKNKEKEKDKN

SEQ ID NO: 170 - protein, 486 aa, Zea mays
MVSRRFKPIELCDSEGRSRQTVAADLDGTLLLSRSAFPYYLLIALEAGSLLRAVALLLSVPLVYLTYVTVSETLAVRAFIYVAMAGLEARDIEAVARSVLPSFYAGDVHPEGWRVFRSFGRRCVVTASPRLMVEPFAKAFLGADVVIGTEVEVAQSGKATGFVAGPGVLVGEHKRRAVAREFGDSLPDVGMGDRESDFDFMSICKEAYTVTRQKYRALPRDQLQGRAILHDGRLARRPTATNALLTFLWMPLGFALALVRAHLHLLLPVRALAYAYKLTGVKLVVRGNRPPPSKKKKGDQLGVLFVCNHRSTLDAVAVGVALGRKVRWVVTDGGAGASRFSEPVVSPIMTGVPLPVPTSLEGDADADAAPRIRRLLEEGDDVVVFPEGAICREPFLLRFGALFAEVTDRIVPVAIEPRESMFHGSTARGLRGMDPYFFFMNPRPTYEVTFLNQLPGELTCGGGRSPVEVASYVQEVLAAQLGFECT

SEQ ID NO: 171 - protein, 501 aa, Arabidopsis thaliana [sequence omitted]

SEQ ID NO: 172 - protein, 500 aa, Arabidopsis thaliana
MSPEKKSQNFPPITECRDGEYDSIAADLDGTLLLSRSSFPYFMLVAVEAGSLLRGLILLLSLPFVIISYLFVSESLGIQILIFISFAGLKIRDIELVSRAVLPRFYAADVRKDSFEVFDKCKRKVVVTANPIVMVEAFVKDYLGGDKVLGTEIEVNPKTNRATGFVKKPGVLVGDLKRLAILKEFGNESPDLGLGDRTSDHDFMSLCKKGYMVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRFSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 173 - protein, 514 aa, Physcomitrella patens
MQQLDPLTSFHCSESFEGVETCRVEGRANQSIVSDLDGTLLRSRSSFPYFMLLAFEAGSPLRSVVLLLISPVVWLVYNFVSEAAGIKMLIFVSLAGLKVSAVESVARGVLPKFYLEDMHSISYRVFTSCGKRYVVTANPRIIVEPFLKEYLDVEAVMGTELQISSGGYVTGFVTGPGVLVGAVKERAVKKYFGPDPPDVGLGDRQSDFLFMDLCKESYIVHSDKDVPAVSKEDFLKPLIFHDGRLVCRPTPLMSLIVMLWCPIGFVLAVVRMLIGIALPMWWALPLEAMLGVTVRVKGIPPTCPLRNKKRGVLFVCSHRTLLDPIFLSIAVRRKVTAVTYSISRLSEVLSPIRTVRLTRDRNTDANTMASLLEEGDLVVCPEGTTCREPYLLRFSSLFAELTDQIVPVTMNIKITMFHGTSARGWKGMDPFFFFMNPCPKYEVTFLDQLPHQLTCNGGKTSHEVANYIQRVLANSLGFQCTNLTRKDKYTVLAGNDGIVPDHTLRQRAGRMFGL

SEQ ID NO: 174 - protein, 501 aa, Physcomitrella patens
MKRDPFDTIDKCSDKGRSKQTVVSDLDGTLLRSRSSFPYFMLVAFEAGGVARAFVLLLCSPLCWLLYHCVSESIGIRLLIFVTFAGLKIGGIEAIARGTLPKFYAEDVHPDTWRIFSSFGERYILTATPRIMAETFAKTYLGVDGVLGTELHFTSGGIATGLLMNPGVLTGRNKEIVLRQEFQGLNLPDVGLGDRPSDHNFMSICKEGYIVPPSNTILAASKESLMNLLVFHDGRLIQRPTAGIALIILLWYPIGAVLAVLRILAGILLPFHLLKLVYKFLGVGVVVRGTPPPEPKDGPGRGGYLYVCSHRTLLDPVMVGVALKRRVTAVTYSISRLSEVLSPIKTVALKRNREKDAAKIRSLLREGDLAICPEGTTCREPYLLRFSALFAELSNQLVPVAMNTRMSMFHGTTAQGWKCLDPFYFFMNPNPIYEVTFLNELPVELTCAGGKSSYEVANHIQQLLSQTLGFECTNYTRKDKYGVLCGNDGSIPLKSQDSFGS

SEQ ID NO: 175 - protein, 517 aa, Physcomitrella patens
METQEPDPVTSFHCSENYDEVENCRVEGRANQSIVSDLDGTLLRSRSSFPYFMLLAFEAGSPLRFIILLLVSPIVWFVYNFISEVVGIKMLIFISLAGLKVSAIESVARGVLPKFFLEDMHSISYRVFISCEKRYVVTANPRIIVEPFLKEYLDVDAVMGTELQISSGGYATGFVTGPGVLVGTAKQRAVKKYFGSDQPDLGLGDRTSDFAFMDLCKEAYIVPSYKEVPSVTKKDYLKPLIFHDGRLVCRPTPLMALAVTLWCPIGFVLAIIRMFIGIMLPMWWALPLEAMLGVTVRIKGIPPTCPLRSKKRGVLFVCSHRTLLDPIFLSIAVRRKVTAVTYSISRLSEVLAPIRTVRLTRDRNTDASTMASLLDEGDLVVCPEGTTCREPYLLRFSSLFAELTDQIVPVTMNIKISMFHGTSARGWKGMDPFFFFMNPRPKYEVTFLDQLPHQLTCNGGKTSHEVANYIQRVLANSLGFQCTNLTRKDKYRVLAGNDGIVPDRSLRQRASRIFGLQ

SEQ ID NO: 176 - protein, 504 aa, Physcomitrella patens
MEVTKLKEAGNYSFAEVKSCSSGNDRRSQTVVADLDGTLIRGRSAFPYFFLVAFEAGSYFRALLLSLMAPLIGFLYYFVDEASGIHLMIFLSFAGLKIKDIEGVARAVLTKFYADDLHPETWRVFSSFGKRVVLTANPRVMVEPFLKEVLGADEVMGTEIEVNKKGRATGRLLKPGVLVGTHKEEALKRCNIGGERPHVGLGDRVTDFPFMAYCKEGYVVPKTKVPAVKKQDMPKQLIFHDGRLVQLPTPRNAFKVLAWMPIGLLLSIVRVTMGVWVPIRLMPLCYKLTGINLVVKGNIPEKPKNGEPGRLFVCNHRTLLDPVIIALALGRPVPAVTYSISKVSEFLSPMPTIGLCRDREKDSANMRRVLKEGELTLCPEGTTCREPFLLRFSALFAELSDRIVPVAVKINMNMFHGTTARGNKAMDPFFAYMNPRPTIELKFLDEIPKNMTCGSGKSSIEVANYIQHLLAGELGYDCTDFTRKDKYRLLAGNDGIVPVKEKTR

SEQ ID NO: 177 - protein, 529 aa, Physcomitrella patens
MEIPGVFDANLFCAESFPEVETCKVEGREKQTIISDLDGTLLRSRSSFPYFMLIAFDAGSPLRFIVLLLASPIIWLVYNFFSEAAGTKLLIFIACAGLKASDIESVARGVLPKFYLEDMHSVSYSIFVSCGKRYVVTANPRIMVESFLKEYMGVEAVIGTELHITKSGYATGLVMGAGVIVGANKTRAVKKYFGDDLPDIALGDRASDFPFMALCKEAYLVPSFKPVEPVAKADYLKPLIFHDGRLVCRPTPLMSLVIILWSPIGLILALIRMVFGTVLPMWYALPLEAMLGVSIRVKGIPPSCPQTSGRRGVLFVCSHRTLLDPIFLSIACRRQVTAVTYSISKVSEILSPIPTVRLTRCRKTDAETMTKLLNEGDLAVCPEGTTCREPYLLRFSSLFAELADQIIPVTMNVKTTMFHGTTARGWKALDPFIFLMNPSPRYELEFLDQLPHEMTCSGGKSSHEVANYIQRVLAASLGFKCTNLTRRDKYRILAGNDGVVPASHFLKQRSRIFACLPSRNSERGQRSDP

SEQ ID NO: 178 - protein, 503 aa, Vitis vinifera
MAVTTFPTVDQCQSIGREKHTVVADMDGTLLIGRSSFPYFALVAFEGGGVLRLLFLLLASPLAGLLYYFVSESAGIQILIFVTFAGMKVSDIESVARAVLPKFYLSDLHPESWRVFSSCGKRCVLTANPRIMVEAFLKDFLGADLVLGTEIATYKGRATGFVCDPGVLVGKNKAYALNKTFGETQPEIGLGDRHTDFPFMASCKEGYIVAAKPEVKAVTSDKLPKPIIFHDSRLVQKPTPLTALLTLLWIPIGFALACLRIAAGSLLPMRIVYHAFWALGVRVSVKGSPPPVAKKSIGQSGVLFICSHRTLLDPIFLSAALGRPIPAVTYSVSRLSEFISPIKTIRLSRDRVKDAAMIKKLLEEGDLAICPEGTTCREPFLLRFSALFAELTDQLVPVAMMNRMSMFHGTTARGWKGMDPFFFFMNPSPAYEVTFLNKLPLELTCSSGKSSHEVANYMQRVIAATLSYECTSFTRKDKYRALAGNDGTVPKKPLLYPDKVMGC

SEQ ID NO: 179 - protein, 501 aa, Vitis vinifera
MSPPPKRARKFPSITTYAGGDHRSIAADLDGTLLVSRSSFPYFMLVAVEAGSLLRGLFLLLSLPIVIVAYLFISEEIGIQILIFISFSGLKIRDIELASQAVLPRFYANDVRRESWEVFEKCERKVVVTANPTLMVEPFVRDFLGGTKVLGTEIEVNPKTKKATGFVKKPGVLVGDRKRLALLKEFGDELPDIGIGDRESDHDFMSICKEGYMVLPSKSATPVPPNRLKTPIIFHDGRFVQPPTPLTALIIYLWLPFGFALSIFRVYFNLPLPERIVRYTYPMLGINLVIRGNPPPPPSPGSPGNLYVCNHRTALDPIVIAIALRRKVSCVTYSVSRLSRFLSPIPAVALTRDRAADAARISSILQKGDLVVCPEGTTCREPYLLRFSALFAELSDRIVPVAVNVKQNMFHGTTVRGVKFWDAYFYFMNPRPTYEITFLDRLPEEMTCKAGGKSAIEVANHVQKVLGGVLGFECTGLTRKDKYMLLGGNDGKVESMYNAKK

SEQ ID NO: 180 - protein, 510 aa, Vitis vinifera
MTKSNLHSPPTSLTIDQCTSIGREKETVVADMDGTLLRGRSSFPYFALVAFEVGGIFRLLLLLLCSPLAGVLYYFISEPAGIQVLIFATFVGMKVSDIESVARAVLPKFYASDLHPEAWRVFSSCGKRCVLTANPRIMVEAFLKDFLGADMVLGTEVDTYKGRATGLVRGGGVLVGKRKAEALRNAFSETSLPEIGLGDRETDYPFMSLCKESYIVPAKPEVEAVSHDKLPKPIVFHDGRLVQKPTPFMALLTILWIPVGFLLACLRIAAGALLPMPLVYYAFWALGVRVYIKGNPPPPAKKSIGQSGVLFICSHRTLLDPIFLSAALGRPIPAVTYSLSRLSEFISPIKTVRLSRDRATDAAMIKKLLEAGDLAICPEGTTCREPFLLRFSALFSELTDELVPVAMANRMTMFHGTTARGWKGMDPFYYFMNPSPAYEVNFLNKLPHELTCGAGKSSHDVANYIQRMIAASLSYECTNFTRKDKYRALAGNDGTVVEKPKVDANKVMGC

SEQ ID NO: 181 - protein, 499 aa, Vitis vinifera
MGAQRHFQPISKCSSDGRANQTVAADLDGTLLVSRSAFPYFMLVALEAGSLVRAILLLASVPLVYFIYLFISESLAIKIFIYMAFAGLKVREIELVSRSVLPKFYAEDVHPESWRVFNSFGKRYIITANPRIMVEPFVKTYMGADKVLGTELEVSNSGRATGFVKKPGVLVGEHKKAAVQQEFGMNLPDVGLGDRDTDHDFMSLCKEGYMVPRTKCEPLPRNKLLSPVIFHEGRLVQRPTPVAALLTFLWMPIGIILSILRVYLNIPLPERIVRYNYKILGIKLIVKGTPPPPPKGGQSGVLFVCNHRTVLDPVVTAVALGRKISCVTYSISKFSELISPIKAVALSREREKDAANIKRLLEEGDLVICPEGTTCREPFLLRFSALFAELTDRIVPVAINTKQSVFYGTSTRGYKLLDPYFVFMNPMPTYEITFLNQLPAELTCKGGKSPIEVANYIQRVLAGTLGFECTNLTRKDKYATLAGTDGSVPFKNEKEKEKA

SEQ ID NO: 182 - protein, 497 aa, Populus trichocarpa
MVMGAHRHFEPIAKCSTEGRSNQTVAADLDGTLLVSRSAFPYFLLVAIEAGSLLRGLILLASVPFVYFTYLFISEAMAIKTFIFIAFAGLKIRDIELVSRSVLPKFYADDVHPETWRVFNSFGKRYIVTANPRIMVEPFVKTFLGADKVLGTELEATKSGRATGFIKKPGVLVGDHKRDALLKEFGTNLPDLGLGDRETDHDFMSICKEGYMVPGTKCEPLARNKLLSPVIFHDGRLVQRPTPLAALLTFLWMPIGIILSILRVYLNIPLPERLAWYTYKLLGIRVIVKGTPPPPPGKGHSGVLFVCNHRTVLDPVVTAVALGRKISCVTYSISKFTEIISPIKAVALSRERDKDAANIKRLLEEGDLVICPEGTTCREPFLLRFSALFAELTDRIVPVAINTKQSVFHGTTVRGHKLLDPYFVFMNPMPTYEVTFLNQLPKELTCKGGKSAIEVANYIQRVLAGTLGFECTNLTRKDKYAKLAGTDGRVLSKKENA

SEQ ID NO: 183 - protein, 501 aa, Populus trichocarpa
MVSFPTVDKCASIGREKHSVVADMDGTLLRGRSSFPYFALLAFEAGGIFRLLFLLLNSPLAGLLYYFVSESAGIKVLIFATCAGMKLSDIESVARAVLPKFYSSDLHSESWRVFSSCGKRCVLTANPRIMVEAFLKDFLGADLVLGTEILTYKGRATGFVQSPGVLVGKNKADALKKAFGKTQPEIGLGDRHTDAPFMALCKEGYIVPPKPEVEAVTTDKLPKPVIFHDGRLVQKPTPLSALLIILWIPIGFILACLRIAAGSLLPMPMVYYAFWALGVRVNIKGTPPPPAKKSIGQSGVLFVCSHRTLLDPIFLSTALGRPIPAVTYSLSRLSEIISPIKTVRLSRDRAADASMIKKLLEEGDLAICPERTTCREPFLLRFSALFAELTDELVPVAMANRMSMFHGTTARGWKGMDPFYFFMNPSPAYEVTFLNKLPLELTLSGGKSSHEVANYIQRVIAATLSYECTSFTRRDKYRALAGNDGNVVEKTKVQANKVMGC

SEQ ID NO: 184 - protein, 501 aa, Populus trichocarpa
MDSFPTVDKCASIGREKHTVVADMDGTLLRGRSSFPYFALLAFEAGGIFRLIFLLLASPLAGLLYYFVSESAGIKVLIFATCAGMKVSDIESVARAVLPKFYSSDLHSESWRVFSSCGKRCVLTANPRIMVEAFLKDFLGADLVLGTEMSTYKGRATGFVQSPGVLVGKNKADALKKAFGMTQPEIGLGDRHTDAPFMALCKEGYIVPPKPEVEAVTTDKLPKPVIFHDGRLVQKPTPLSALLTILWIPIGFILACLRIAAGSLLPMPMVYYAFWALGVRVIIKGTPPPPAKKSIGQSGVLFICSHRTLLDPIFLSTALGRPIPAVTYSVSRLSEIISPIKTVRLSRDRATDASMIKKLLEEGDLAICPEGTTCREPFLLRFSALFAELTDQLVPVAVVNRMSMFHGTTARGWKGMDPFYFFMNPSPAYEVTFLNRLPQELTCTGGKSSHEVANYIQRVIAATLSYECTSFTRRDKYRALAGNDGTVVEKTKLQANKVMGC

SEQ ID NO: 185 - protein, 500 aa, Populus trichocarpa
MVMGAHRHFEPIAKCSTEGRSNQTVAADLDGTLLVSRSAFPYFLLVAIEAGSLLRGLILLSSVPFVYFTYLIISEEMAIKTFIFIAFAGLKIRDIELVSRSVLPKFYADDVHPETWRVFNSFGKRYIVTANPRIMVEPFAKNFLGADKVLGTEIQATKSGRATGFVKKPGVLVGDHKRNALLKEFGTSLPDLGLGDRETDHDFMSICKEGYIVPRSKCEPLPRNKLLSPVIFHEGRLVQRPTPLVALLTFLWMPIGIILSVLRVYLNIPLPERIAWYNYKLLGIRVVVKGNPPPPPRKGQSGVLFVCNHRTVLDPVVTAVALRRKISCVTYSISKFTEIISPIKAVALSRERDRDAANIKRLLEEGDLVICPEGTTCREPFLLRFSALFAELTDRIVPVAINTKQSVFNGTTVRGHKLLDPYFVFMNPMPTYEITFLNQLPTELTCKGGKSSIEVANYIQRVLAGTLGFECTNLTRKDKYAILAGTDGRVATKKEKASEN

SEQ ID NO: 186 - protein, 524 aa, Sorghum bicolor
MERPSPTCLAANGPRRKARTIPFPPPPADLRTGRLRSRQTVAADLDGTLLLSRSAFPYYLLVALEAGSLLRAVALLMSVPFVYLTYVTVSETLAVRAFLYVAVAGLDVSDIEAVARTVLPRFYAGDVHPEGWRVFRSFGRRCVVTASPRVMVEPFARAFLGADVVIGTEMEVGASGKATGFVAGPGVLVGEHKRRAVVREFGDALPDVGMGDRESDFDFMAICKEAYMVTRQKYRALPREQLQSRVILHDGRLARRPTATNTLLTLLWMPLGFALALARVHLHLLLPARALSYAYKLMGVKLVVRGNRPPPPPPSKKGGGPGVLFVCNHRTTLDPVAVAVALGRKVRWVVTDGASSRFSEAVSPVMTGVALPVPVPSRESDDDADAAARIRRLLEEGDDVVIFPEGTICREPFLLRFGALFAEVTDRIVPVAIGAREGMFHGSTARGLRRMDPYFFFMNPRPTYEVTFLNQLPRELTCGGGRSPVEVANYVQEVLAAQLGFDCTCTSKQAKTGWSPAAPTVAWR

SEQ ID NO: 187 - protein, 503 aa, Sorghum bicolor
MVASYRSRRFKPIEECCSEGRSEQTVAADLDGTLLISRSAFPYYLLVALEAGSVLRAVLLLLSVPFVYVTYIFFSESLAISTLVYISVAGLKVRSIEMVARSVLPRFYAGDVHPESWRVFNSFGKRYIITASPRIMVEPFARAFLGADKVVGTELEVGKNGKATGFMVKPGVLVGDHKKKAVVKELGDAVPDVGMGDRETDFDFMSICKEAYLVTSRKYSPVGKNQLLSPLILHDGRLVQRPTPLVALVTFLWMPFGFALALMRVYINLPLPERIVYYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLTQLPKDLTCSGGKSPIEVANYIQKTLSGQLGFECTTITRKEKYGILAGTDGRVPSKNKDKEKEKN

SEQ ID NO: 188 - protein, 505 aa, Sorghum bicolor
MAASPFPTVEKCSSTDRSGDTVVADLDGTLLCGRSSFPYFAHMAFETGGVLRLLLLIALAPLAGLLYYFVSEPAGIQVLIFASMAGARVADIEAVARAVLPKFYCADLHPESWRVFSACGRRCVLTANPRIMVEAFLKEYVGTDVVVGTELVVWRGRATGLVRSPGVLVGEQKADALRRTFGDDVAPEVGLGDRKTDYPFMRLCKEGYVVPATPKLKPVPRENLPKPVVFHDGRLVQKPSPALALLTVLWIPIGFLLACLRIAAGALLPMRMVYHAFRALGVRVTIRGNPPPPASRETGQTGVLFICSHRTLLDPIFLSTALGRPITAVTYSVSRLSEILSPIRTVRLTRDRAADAAMIRRLLTEGDLVICPEGTTCREPFLLRFSALFAELTDEIVPVAMENQMSMFHGTTARGWKGLDPFYFFMNPSPGYVVTFLNKLPAELTCNGGGKSSHEVANYIQRLIASTLSYECTNFTRKDKYKALAGNDGTVVSKPNIDKNKVMGC

SEQ ID NO: 189 - protein, 518 aa, Sorghum bicolor
MEEAVEAVVAAGVEPFPTVDKCDASGLGAHSSVVADLDGTLLRSRSAFPYYALVAFETGGVPRLLLLLLLSPLAALLRFLASESACLRVLVFGATAGARVRDVESAARAVLPRFYAADVHPAAWRVFSACSRRRVVLTATPRLFAEPFLRDCLGADAVAGTELATWRGRATGLVDARRGGVLVGRSKAQALREILAADGGDAPDVGLGDSRSDYPFMSMCKEAYIVPRAPVEPALPMDQLPRPVIFHDGRLVRRPTPLVALVVVLWFPVGLALACLRIAAGALLPMPLVYYAFWALGVRVVVRGAPPPPRAERATGRRGVLFACSHRTLLDPIFLSTALGRPVAAVTYSLSRLSEFLSPIRTVRLSRDRATDAAMIRDLLAEGDLVICPEGTTCREPFLLRFSALFAELTSEVVPVAMENRMSMFHGTTARGWKGMDPFYFFMNPSPAYVVTFLNKLPPELTCAGGRTSHEVANYIQRLIAATLSYECTSLTRKDKYRALAGNDGVVATPKPPPTVAS

SEQ ID NO: 190 - protein, 501 aa, Ricinus communis
MPAMKQAQKFPSITSCSGTSYESIAADLDGTLLVSSSSFPYFMLVAVEAGSLLRGLVLLLSLPFIIISYFFISEAIGIQILIFISFAGLKIRDIELVSRAVLPRFYAADVRKESYEVFDRCKRKVVVTANPTIMVEPFVKDFLGGDKVLGTEIEVNPKTKRATGFVKKPGVLVGKWKKLAILKEFGEDAPDLGIGDRKTDHDFMSICKEGYMVYHSKKAATPLPRDRLKSPIIFHDGRFVQRPDPLNALATYLWLPFGFMLSIFRVYFNLPLPERIVRYTYEMLGIHLVIRGYPPPAPSRGTPGNLYVCNHRTALDPIVIAIALGRKVSCVTYSVSRLSRFLSPIPAIALTRDRAADAERITALLQKGDLVVCPEGTTCREQFLLRFSALFAEMSDRIVPVAVNCKQSMFYGTTVRGVKFWDPYFFFMNPRPTYEVTFLDRLPEEMTVKAGGKSSIEVANYVQKVLGDVLGFQCTGLTRKDKYLLLGGNDGKVESMYNSKK

SEQ ID NO: 191 - protein, 512 aa, Ricinus communis
MANPKETYAPFSSFPNIEKCTSVGRQNDTVVTDMDGTLLCGRSPFPYFALVAYEASGILRLLFLLLGSPIAGILRYFISESAGIRVLVFATFAGMRVSDIESVARAVLPKFYSSDLHPETWRVFSSCGKKCVITENPRIMVEAFLKEFVGADMVIGTEIVVHKGRATGFIRSPGVLVGQNKADALKMAFYDAPVPNIGIGDRRTDRPFMKLCKESYIVPSNSQVEPVGPKKLPKPIVFHDGRLVQKPTHLIALATLLWIPVGFILACLRLAAGALLPMPLVYYALWALGVRIHIKGTPPPPAKKSTGQAGVLFVCSHRTLLDPVFLSIALGRPIPAVTYSLSRLSEFISPIKTVRLTRDRVTDANMIKELLQEGDLVICPEGTTCREPFLLRFSALFAELTDELVPVAMANKMTMFHGTTARGWKGMDPFYFLMNPSPAYEVTFLNKLPYNLTCGAGKSSHSVANYIQRTIAATLSYQCTSFTRKDKYRALAGNDGTVVEEPKQARDEVMDS

SEQ ID NO: 192 - protein, 504 aa, Ricinus communis
MVMVDSFPEVSKCASKGREKHTVVADMDGTLFIGRSSFPYFALIAFEAGGIFRLLFLLLASPLAALLYYFVSESAGIQVLIFASFAGMKVSDIESVARAVLPKFYSSDLHPESWRVFSSCGKRCVLTANPRIMVEAFLKDFLGADLVFGTEISTYKGRATGFVRTPGVLVGKNKANALKKAFGDARPEVGLGDRRTDAPFMALCKEGYLVPPKPEVRAVTGDKLPKPIVFHDGRLVQKPTPLMALLIILWIPIGFILACLRIAAGSLLPMPMVYYAFLALGVRVTVKGNPPPPAKKSTGQSGVLFVCSHRTLLDPIFLSTALGRPIAAVTYSVSRLSEIISPIKTVRLSRDRATDAAMIKKLLVEGDLAICPEGTTCREPFLLRFSALFAELTDQIVPVAMVNRMSMFHGTTARGWKGMDPFYFFMNPSPAYEVTFLSKLPQELTCSSGKSSHEVANYIQRVIAATLSYECTGFTRKDKYRALAGNDGSVVEKPKLEANKVMGC

SEQ ID NO: 193 - protein, 498 aa, Arabidopsis lyrata
MSPAKKSGNFPPITECRDGEYDSIAADLDGTLLLSRSSFPYFMLVAVEAGSLFRGLILLLSLPIVIISYLFVSESLGIQILIFISFAGLKIRDIELVSRAVLPRFYAADVRKDSFDVFDKCKRKVVVTANPIVMVEAFVKDYLGGDKVLGTEIEVNPKSNRATGFVKKPGVLVGDLKRLAILKEFGDESPDLGLGDRTSDHDFMSLCKKGYMVHACKSATTIPKERLKNRIVFHDGRLAQRPTPLNAIVTYLWLPFGFILSIIRVYFNLPLPERFVRYTYEILGIHLTIRGHRPPPPSPGTLGNLYVLNHRTALDPIIVAIALGRKICCVTYSVSRLSLMLSPIPAVALTRDRVTDAANMRKLLEKGDLVICPEGTTCREEYLLRFSALFSELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESIMLG

SEQ ID NO: 194 - protein, 501 aa, Arabidopsis lyrata
MGAQEKRRRFEPISKCDVKDRSNHTVAADLDGTLLISRSAFPYYFLVALEAGGLLRALILLVSVPFVYLTYLTVSETLAINVFVFITFAGLKIRDVELVVRSVLPRFYAEDVRPDTWRIFNTFGKRYIVTASPRIMVEPFVKTYLGVDKVLGTELEVSKSGRATGFTRKPGILVGQHKREVVLREFGSLASDLPDLGLGDSKTDYDFMSICKEGYMVPRTKCEPLPRNKLLSPIIFHEGRLVQRPTPLVALLTLLWLPIGFLLSLIRVYTNIPLPERIARYNYKLTGIKLIVNGHPPPPPKPGQPGHLLVCNHRTVLDPVVTAVALGRKISCVTYSISKFSELISPIKAVALTRQREKDAANIKRLLEEGDLVICPEGTTCREPFLLRFSALFAELTDRIVPVAINTKQSMFNGTTTRGYKLLDPYFAFMNPRPTYEITFLKQIPAELTCKGGKSPIEVANYIQRVLGGTLGFECTNFTRKDKYAMLAGTDGRVPVKKEKT

SEQ ID NO: 195 - protein, 502 aa, Vernicia fordii
MSQTKPAPKFPSITSCTGSAYQSIAADLDGTLLVSSSSFPYFMLVAVEAGSLLRGLVSLLSLPLVIISYFFISEAVGIQILIYISFAGLKIRDIELVSRAVLPRFYAADVRKESFEVFDKCKRKVVVTANPTIMVEPFVKDFLGGDKVLGTEIEVNPKTKRATGFVKNPGVLVGKWKKLSILKEFGEESPDLGIGDRKTDHDFMSICKEGYMVQRSKSATPIPLDRLKSRIIFHDGRFVQRPDPLNALVTYLWLPFGFILSIIRVYFNLPLPERIVRYTYEMLGIHLVIRGNPPPAPSPGTPGNLYVCNHRSALDPIVIAIALGRKVSCVTYSVSRLSRFLSPIPAIALTRDRAADAARISELLQKGDLVVCPEGTTCREPFLLRFSALFAEMSDRIVPVAVNCKQNMFYGTTVRGVKFWDPYYFFMNPRPTYEVTFLDRLPEEMTAKAGGKSSIEVANYVQKVLGDVLGFECTGLTRKDKYMLLGGNDGKVESMYNTKKAG

SEQ ID NO: 196 - protein, 514 aa, Oryza sativa
MGDATMIASPFPAVEKCSSKDRGGDTIVADLDGTLLCGRSSFPYFAHMAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 197 - protein, 503 aa, Arabidopsis thaliana; identical to SEQ ID NO: 144

SEQ ID NO: 198 - protein, 500 aa, Populus trichocarpa
MSPTKPAKKFPPITACNGTTHQSIAADLDGTLLVSSSSFPYFMIVAVEAGSLFRGLVLLLSLPIVIVSYLFISEALGIQMLIFISMSGLKIRDIELVSRAVLPRFYAADVRSESFEVFDRCKRKVVVTANPTIMVEPFVKDFLGGDKVLGTEIEVNPKTKRATGFVKKPGVLVGKWKELAVLKEFGEEAPDLGIGDRKTDHDFMSLCKEGYMVHRSKSATPLPRDRLKNRIIFHDGRLVQRPDPLNALITYIWLPFGFILSIIRVYFNLPLPERIVRYTYEMLGIHLVIRGTPPPAPSPGTPGNLYVCNHRTALDPIVIAIALGRKVSCVTYSVSRLSRFLSPIPAIALTRDRAADAARISSILQKGDLVVCPEGTTCREEFLLRFSALFAELSDRIVPVAVNCKQNMFYGTTVRGVKFWDPYFFFMNPRPTYEVTFLDRLPEEMTVKAGGKSSIEVANYVQKVLGEVLGFENTGLTRKDKYLLLGGNDGKVESMHNAKK

SEQ ID NO: 199 - protein, 518 aa, Sorghum bicolor
MAPAASARFPPVSSYDASARTRRTAAADLDGTLLASSSAFPYYFLVALEAGSCLRAAALLLVAPLLLALYTLVSEAAAIALLAFVTFAGLRVRDVEAVARGVLPRHYAAGVRADTWTVFRGCGEGRRVVVTASPAVMVGEFVREFLGAEVAGTELETFSAFGAARFTGRIKAVLVGERKAEVVRRLFAGGEMPDVGLGDRESDHDFMAICKEAYMVPPDKRAARAAADTLLSRSVFHDGRLVQRPDPAQALFALAYLPLGFLLALFRVFFNLMMPLRLVRHTYRLTGIRLRVRGTPPPPPAPGAPGSLLVCNHRTALDPIILSVALGRPVSCVTYSASRLSTAISPIRAVALSRDRATDAARMAALLAEGDVVVCPEGTTCREPCLLRFSALFAELTDRIVPVAMEARQGTYYGSTARGWKWLDPYFFYMNPRPGYDVTFLPPLRPEETCGAGGRSAVDVANHVQRVIAKELGFQCTTLTRKDKYMKLAGNDGSVAARAKKDAADDNAATVTTTKKFV

SEQ ID NO: 200 - protein, 293 aa, Ricinus communis
MSICKEGYMVPRTKCEPLPRNKLLSPVIFHEGRLVQRPTPLVALLTFLWMPIGIILSILRVYLNIPLPERIAYYNYKILGIKVIVKGTPPPAPRKGQSGVLFVCNHRTVLDPVVTAVALGRKISCVTYSISKFTEIISPIKAVALSREREKDAANIKRLLEEGDLVICPEGTTCREPFLLRFSALFAELTDRIVPVAINTKQTVFHGTTVRGHKLLDPYFVFMNPMPTYEITFLNQLPIELTCKGGKSSIEVANYIQRVLAGTLGFECTNLTRKDKYAILAGTDGRVPSKKEK

SEQ ID NO: 201 - protein, 502 aa, Arabidopsis lyrata
MSPAKKSRSFPPISECKSREYDSIAADLDGTLLLSRSSFPYFMLVAIEAGSLFRGLILLLSLPIVIIAYLFVSESLGIQILIYISFAGIKIKNIELVSRAVLPRFYAADVRKDSFEVFDKCKRKVVVTANPIVMVEPFVKDYLGGEKVLGTEIEVNPKTMKATGFVKKPGVLVGDLKRLAILKEFGEESPDIGLGDRTSDHDFMSICKEGYMVHETKSATTVPIERLKNRIIFHDGRLVQRPTPLNALIIYLWLPFGFMLSIFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSMD

SEQ ID NO: 202 - protein, 585 aa, Arabidopsis thaliana
MVLPELLVILAEWVLYRLLAKSCYRAARKLRGYGFQLKNLLSLSKTQSLHNNSQHHLHNHHQQNHPNQTLQDSLDPLFPSLTKYQELLLDKNRACSVSSDHYRDTFFCDIDGVLLRQHSSKHFHTFFPYFMLVAFEGGSIIRAILLLLSCSFLWTLQQETKLRVLSFITFSGLRVKDMDNVSRSVLPKFFLENLNIQVYDIWARTEYSKVVFTSLPQVLVERFLREHLNADDVIGTKLQEIKVMGRKFYTGLASGSGFVLKHKSAEDYFFDSKKKPALGIGSSSSPQDHIFISICKEAYFWNEEESMSKNNALPRERYPKPLIFHDGRLAFLPTPLATLAMFIWLPIGFLLAVFRISVGVFLPYHVANFLASMSGVRITFKTHNLNNGRPEKGNSGVLYVCNHRTLLDPVFLTTSLGKPLTAVTYSLSKFSEFIAPLKTVSLKRDRKKDGEAMQRLLSKGDLVVCPEGTTCREPYLLRFSPLFAELTEDIVPVAVDARVSMFYGTTASGLKCLDPIFFLMNPRPVYCLEILKKLPKEMTCAGGKSSFEVANFIQGELARVLGFECTNLTRRDKYLVLAGNEGIVR

SEQ ID NO: 203 - protein, 520 aa, Arabidopsis thaliana
MSAKISIFQALVFLFYRFILRRYRNSKPKYQNGPSSLLQSDLSRHTLIFNVEGALLKSDSLFPYFMLVAFEAGGVIRSFLLFILYPLISLMSHEMGVKVMVMVSFFGIKKEGFRAGRAVLPKYFLEDVGLEMFEVLKRGGKKIGVSDDLPQVMIEGFLRDYLEIDVVVGREMKVVGGYYLGIMEDKTKHDLVFDELVRKERLNTGRVIGITSFNTSLHRYLFSQFCQEIYFVKKSDKRSWQTLPRSQYPKPLIFHDGRLAIKPTLMNTLVLFMWGPFAAAAAAARLFVSLCIPYSLSIPILAFSGCRLTVTNDYVSSQKQKPSQRKGCLFVCNHRTLLDPLYVAFALRKKNIKTVTYSLSRVSEILAPIKTVRLTRDRVSDGQAMEKLLTEGDLVVCPEGTTCREPYLLRFSPLFTEVSDVIVPVAVTVHVTFFYGTTASGLKALDPLFFLLDPYPTYTIQFLDPVSGATCQDPDGKLKFEVANNVQSDIGKALDFECTSLTRKDKYLILAGNNGVVKKN

SEQ ID NO: 204 - DNA, 1330 bp, Arabidopsis thaliana
agttaaaagattggttatttgggctctgcactcaagtgagagagaagatagatagatctgagtagaatcttcgattcattattcgttgtcgtcgttcatctgtgagaagcggacaaaccaaagaatccaccggagctagtgatatgggtggttccagagagttccgagctgaggaacattcaaatcaattccactctatcatcgccatggccatctggcttggcgccattcacttcaacgtcgctcttgttctctgttctctcattttccttcctccttctctatctctcatggtcttgggcttgctctctctgtttatctttatcccaatcgatcatcgtagcaaatatggtcgtaagctcgctaggtacatatgcaagcacgcgtgtaattatttccccgtctctctgtacgtcgaggattacgaagctttccagcctaatcgtgcctatgtctttggttatgaaccacattcggtgctaccgattggagttgttgctctttgtgatctcacagggtttatgcctattcctaacattaaagttcttgcaagtagtgctatattctacactccctttctaaggcatatatggacatggttagggctcaccgctgcttctaggaagaatttcacttcccttttggattctggctacagttgtgttcttgtacctggtggtgtgcaggagacttttcatatgcaacatgatgctgagaatgtcttcctttcaaggagaagaggatttgtgcgcatagccatggaacaggggagccctctggttccagtattctgctttggtcaggcacgcgtgtacaaatggtggaagccggattgtgatctctatcttaaactatctagagcaatcagattcaccccgatctgcttctggggagtttttggatcaccattaccgtgtcgacagcctatgcatgtggtcgttggtaaaccaatagaagtcacaaaaactctgaagccaactgacgaagagattgctaagtttcatggccagtatgtggaagcgcttagggatctgtttgagaggcacaagtcccgagtcggctatgatcttgagctgaaaattctttgaacaaaatctccaatggaaataattacttgtgtgtatccttcattaattgttaccttggagctggatttggacttaatataaatgactacatcatgtagtctacatgtattgcatgtctttagcatcgactgttgaagtaatggaatacgtttataaagcctgtaaattacatgtcgtcttgcacaagagtatgtggtaataataacatttgacccaaaaataatactagttaaatttttcct

SEQ ID NO: 205 - DNA, 1381 bp, Ricinus communis
  misc_feature (1347)..(1347): n is a, c, g, or t
actggagcacgaggacactgacatggactgaaggagtagaaaagggacgcaaaaaaagattttacatggcggagaggtcgatgctgctttattttcattaatacagaaagagtttgagcactgagcactgaatagcaagaagaagaagaagaagaaatgggggaagaagcgaatcataataataataataataatatcaatagtaatgatgagaagaatgaagagaaatcaaattatacagttgtaaattcgagagaactatacccaacgaacatatttcacgcactgttagcgttgagcatatggattggttcaatccatttcaatctcttcttactcttcatctcttatctcttcctttcttttcccacattcctcctgattgttggattttttgtggtgttaatgttcattccgatcgacgaacacagtaagttgggccgtcgtttgtgcaggtatgtatgcagacatgcgtgcagtcattttccggtaactctccatgttgaagacatgaatgcttttcattctgatcgtgcttacgtttttggttatgagccacattcagtatttccccttggtgtttctgtactatcagatcactttgctgtcctgccccttcctaaaatgaaggtccttgcaagtaacgctgtgtttcggacaccagttttaaggcatatatggacatggtgtggtcttacatcagcaacaaagaaaaatttcactgccctcctagcatctggttatagttgcattgtgattcccggtggagttcaagagacattttatatgaagcatggctctgagattgctttccttaaggcgagaagagggtttgtccgagtagctatggagatgggtaaacccttggttccagttttctgctttggtcaatcgaacgtgtacaagtggtggaaacctgatggcgagttatttatgaaaattgctagagctattaagttcagcccaattgtcttttggggagttctcggttctcatttaccgctacaacgtccaatgcatgttgtcgtcggtaaaccgattgaggtgaagcaaaatccacagcctacagtggaagaggtctcagaagtacagggtcagtttgttgcggcacttaaagatctttttgaaaggcataaagcacgggttggctatgcagaccttacacttgaaattctttgatagaagtcagtacttgttttagttcagttggatgcctctttcagtttttggcgataatgtttgtattcattagataattaggaaaatgaaatgtaaaacggtgaataaagcttttcaatatgcgggcatcacaaagttgttctagatatccaaaaaaaaaaaaaaacnctgtatgccgttacgtaccgtatcgttgacagca

SEQ ID NO: 206 - DNA, 1257 bp, Vernicia fordii
agaagggcgatgcacatgatactctcctcttaataagagtattgatacccagagaagccagaagcaagaaacaaacaacttttgcaagaaggagattaaaatggggatggtggaagttaagaatgaagaagaggttaccatattcaaatctggagaaatatacccaacaaacatttttcaatcagtgttagctttggctatatggcttggctctttccatttcatcctcttcttagtctcttcttcaatcttccttcctttctccaaatttctcctcgttattgggttgcttttgttttttatggtgattcctatcaacgatcgcagtaagcttggccaatgcttgttcagctatatatctaggcatgtttgcagctattttcccatcactcttcatgttgaagatataaatgcctttcgttctgatcgtgcttacgtgtttggttatgagccacattcagtttttcccattggtgtgatgattctttctttgggtttaattcctcttcctaatataaaattccttgcaagtagtgctgtgttctacactccatttttaagacatatatggtcatggtgtggtcttacaccagcaacaaggaaaaattttgtttccctcctgtcttctggttatagttgcattctggtgcctggtggagtccaagagacattttatatgaagcaggactctgagattgctttccttaaggcaagaagaggatttattcgaatagctatgcagacgggcacacccttggttcctgttttctgctttggtcaaatgcacacattcaaatggtggaaacctgatggagagttgttcatgaaaattgctagagctattaaattcaccccaactatcttttggggagttctcggaactcctttacccttcaaaaatccaatgcatgtcgtggtgggtagacccattgaggtgaagcaaaatccacagcctaccgctgaagaggttgcggaagtacagagagagtttattgcatcacttaaaaatctctttgaaaggcacaaagcacgggtcggctattcagaccttaaacttgaaattttttgaccagaaatcagaacttaaaagtagttttgcatgctttctcattttcatttatttagtttttttttaaacctttttttttcccttttgttaatttgtgttcttagataatgatgaaaatgagaaaaaaaaaaaatttgtaaaacagctaataagccttaattttgtggcaaaaaaaaaaaaaaaaaaaa

SEQ ID NO: 207 - DNA, 1280 bp, Mortierella ramanniana
  misc_feature (1265)..(1266): n is a, c, g, or t
  misc_feature (1269)..(1269): n is a, c, g, or t
  misc_feature (1275)..(1275): n is a, c, g, or t
  misc_feature (1277)..(1277): n is a, c, g, or t
  misc_feature (1279)..(1279): n is a, c, g, or t
tgcaaagtcacactttcagtcagccatggccagcaaggatcaacatttacagcagaaggtcaagcatacgctagaagctatcccatcccctcgctatgctccattgcgagtgccattaagacggagattacaaacattggcagttttattatggtgttccatgatgtcaatatgcatgttcatattcttctttttatgctccattcctgttctcctttggttccccattatcctttatttgacctggatcttggtgtgggataaggcgccagagaacggtggaagacctattcgctggctgcggaatgctgcttggtggaagctgtttgcagggtattttcccgcacatgtcatcaaggaagccgatttagatccatccaagaactacatctttggttatcacccccatggaatcatatccatgggctcgttctgtacttttagtaccaatgctactggctttgatgacttgttcccaggcatccggccatcgcttttgacattaacatctaattttaatatcccactttatcgtgattatttgatggcgtgcggactttgctccgtctccaaaacatcctgtcaaaatattttaaccaaaggtggtccgggccgttccattgccattgtcgtgggaggtgcttccgagtctctcaatgctagacccggtgtcatggaccttgtgttgaagagacgctttggttttatcaagattgctgttcaaaccggtgcaagtctagtgcccactatcagttttggtgaaaatgagctgtacgaacagattgaaagcaatgaaaactcaaagttgcatagatggcaaaagaagattcaacatgcccttggttttactatgccgctctttcatggacgcggtgtattcaattatgactttggtttgctcccccatcgccatcctatctacacgattgttggaaagcccatccccgtccctagcatcaagtatggacagacaaaggatgagattataagagaactacatgactcgtacatgcatgccgtgcaggatctctatgatcgttacaaggatatctatgcaaaggatcgggtaaaagaactagaattcgtcgaatagttgggttgttaccatttaacgttttcttcaaatttttcattgattataccgcttcatcccgacctggttttttattgaatgggtttctcatctccagttcaattcccactcctgcatgtatctattatcatcatcctttctaataatgaaaaccttttgaacgtttcataannaanagaaananana

SEQ ID NO: 208 - DNA, 2485 bp, Homo sapiens
tgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaaaaaaaaaaaaaaaaaaaaaaa

SEQ ID NO: 209 - DNA, 1411 bp, Homo sapiens
actgttctgagatctttgcctccctcaggctcccgagaatcatggctcattccaagcagcctagtcacttccagagtctgatgcttctgcagtggcctttgagctaccttgccatcttttggatcttgcagccattgttcgtctacctgctgtttacatccttgtggccgctaccagtgctttactttgcctggttgttcctggactggaagaccccagagcgaggtggcaggcgttcggcctgggtaaggaactggtgtgtctggacccacatcagggactatttccccattacgatcctgaagacaaaggacctatcacctgagcacaactacctcatgggggttcacccccatggcctcctgacctttggcgccttctgcaacttctgcactgaggccacaggcttctcgaagaccttcccaggcatcactcctcacttggccacgctgtcctggttcttcaagatcccctttgttagggagtacctcatggccaaaggtgtgtgctctgtgagccagccagccatcaactatctgctgagccatggcactggcaacctcgtgggcattgtagtgggaggtgtgggtgaggccctgcaaagtgtgcccaacaccaccaccctcatcctccagaagcgcaaggggttcgtgcgcacagccctccagcatggggctcatctggtccccaccttcacttttggggaaactgaggtgtatgatcaggtgctgttccataaggatagcaggatgtacaagttccagagctgcttccgccgtatctttggtttctactgttgtgtcttctatggacaaagcttctgtcaaggctccactgggctcctgccatactccaggcctattgtcactgtggttggggagcctctgccactgccccaaattgaaaagccaagccaggagatggtggacaaataccatgcactttatatggatgctctgcacaaactgttcgaccagcataagacccactatggctgctcagagacccaaaagctgtttttcctgtgaatgaaggtactgcatgcccaggagcacaggagtgcctgccttgaagaagagactcatctgccactaaccaaagacaggcaggagatgagggaggttatatgtggtaggggagggcatgaggaattccttctttgccttcttgccacagggtccttacaggaattctttctgaagagctgcacacagtcattcctcaaaggagggcatcctagtgcccctcatgctggggcctgatgcctggtcatcatttgagtcctctgggacacattagcagtcactgcatattcccccagcccctgggcaactatctactttctgtctctgtggatttgccaattctgaacattttatataaatggaataatacaataaaaaaaaaaaaa

SEQ ID NO: 210 - DNA, 2488 bp, Bos taurus
gccgtggccgtggccaaggctccgctttccgccggtgctccggcccgtctggcggcccgtccctccgcaccctcggccgtagcggtccccgcgctcccctgctcggcgcgaagccctggccccggcggccggggcatgggccaggggcgcggggtctggcggcttcccgcggggccccgacctgtactggcttcgtcatgaagaccctcatagccgcctactccggggtcctgcgaggcactggctccagcatcctctctgccctccaggacctgttttctgtcacttggctcaataggtccaaggtagagaagcagctccaagtcatctcggtgctacaatgggtcctgtctttcctcgtgctgggagtggcctgcagcgtcatcctcatgtacacattctgcaccgattgctggctcattgccgtgctctacttcacctggctggtgtttgactggaacacacccaagaaaggtggcaggaggtcacagtgggtccgaaactgggctgtgtggcgctactttcgagactactttcccattcagctggtgaagacacacaacttactgaccagcaggaactacatctttgggtaccatccccatggcatcatgggcctgggtgccttctgcaacttcagcacagaggccacagaagtaagcaagaagttccctggcataaggccctacctggccacgctggccggcaacttccggatgccagtgctgcgggagtacctgatgtctggaggcatctgcccagtgaaccgggacaccatagactacttgctttcaaagaatgggagtggcaatgccatcatcatcgtggtggggggcgcggctgaatccctgagctccatgcccggcaagaatgcagtcaccctgcgcaatcgcaagggctttgtgaaactggccctgcgccatggagccgacctggttcccacctactcctttggggagaatgaggtgtacaagcaggtgatctttgaggagggctcctggggccggtgggtgcagaagaagttccagaagtacattggctttgccccatgcatcttccatggtcgaggcctcttctcctctgacacctgggggctggtgccctactccaagcccatcaccactgtcgtgggcgagcccattaccatccccaggctggagcgcccgacgcagcaggacatcgacctgtaccacgccatgtacgtgcaagccctggtgaagctcttcgaccagcataagaccaagttcggcctcccggagaccgaggtcctggaggtgaactgagcctgtctgcaggggccagcttctgggaggaaccatctgcaaatcgttttctaccaagttctcaagtgctttttgttctgtaaatttggaagcatcatgggtgtctgtgggttatttaaaagaaattataataattttgttaaaccgttacaatgttaggtcttttttaagaaggagaaagggaatatttcaagctctctcagttccagtttgtcctgttccaggtgggcgctgccacatctgggcctttatggtttcacaacccctcttctctcctcccccaaattacagagaaaattcagtcctggttaactggggaagaaggacagtcattagtgactcgggccagttagattatttgccctttggccctgagggatgaggggcagaagcctcctctagtacaaacatctctatgcccagctacccaaggcttgactgcaggactaaaccctcttgccaaggaaagacacagaggaaacaggtgttcccatgctgaagagtgcagggataagcacctggaatattcaagcttgattctcctttctgccacccccatggccccagtctctgaaatctgagcctggactggcctccaaagagaggatcagggtggcagtgttcctgtgctggagaatggagctgtccagatgaaccatctcttgggttatcaagccccatcatgttctggttggagtgactggttttcctcagggggctgatgacacagacccagacccagcacagaccctgccttggcctgccagtggcctcgctttgcttaacccacatcctcagcagtggatgcgaggaaggggtcccctttcctgtttacagaggggcctgagcagtagactggtaccagaacagaagttccccgaacccaaacctcatgtatttgtgccttttctgagaggggggccaggggggacagctagtactctgtgtactctgctttctcttgatgagatcattataccatgtcagactttcgtatattcctaaatggataaatgaaaacaagtgtcctctatgagttattgttagggtcacattagcatcttgctgctgatgattggggagaccactgccccagctgggctgcctgctaagccctctcccactttctccttcagcccaaatggccctttgtatattagttatcaattgctgtgtaataaattactccaaaacttggtggctgc

SEQ ID NO: 211 - DNA, 1330 bp, Mus musculus
ggtcaggggcgcggcgtgaggcggctttctgcacggccgtgacgtgcattggcttcagcatgaagaccctcatcgccgcctactccggggtcctgcggggtgagcgtcgggcggaagctgcccgcagcgaaaacaagaataaaggatctgccctgtcacgcgaggggtctgggcgatggggcactggctccagcatcctctcagccctccaagacatcttctctgtcacctggctcaacagatctaaggtggaaaaacagctgcaggtcatctcagtactacaatgggtcctatccttcctggtgctaggagtggcctgcagtgtcatcctcatgtacaccttctgcacagactgctggctgatagctgtgctctacttcacctggctggcatttgactggaacacgcccaagaaaggtggcaggagatcgcagtgggtgcgaaactgggccgtgtggcgctacttccgagactactttcccatccagctggtgaagacacacaacctgctgaccaccaggaactatatctttggataccacccccatggcatcatgggcctgggtgccttctgtaacttcagcacagaggctactgaagtcagcaagaagtttcctggcataaggccctatttggctacgttggctggtaacttccggatgcctgtgcttcgcgagtacctgatgtctggaggcatctgccctgtcaaccgagacaccatagactacttgctctccaagaatgggagtggcaatgctatcatcatcgtggtgggaggtgcagctgagtccctgagctccatgcctggcaagaacgcagtcaccctgaagaaccgcaaaggctttgtgaagctggccctgcgccatggagctgatctggttcccacttattcctttggagagaatgaggtatacaagcaggtgatctttgaggagggttcctggggccgatgggtccagaagaagttccagaagtatattggtttcgccccctgcatcttccatggccgaggcctcttctcctctgacacctgggggctggtgccctactccaagcccatcaccaccgtcgtgggggagcccatcactgtccccaagctggagcacccgacccagaaagacatcgacctgtaccatgccatgtacatggaggccctggtgaagctctttgacaatcacaagaccaaatttggccttccagagactgaggtgctggaggtgaactgacccagcccgcgcgtgccagctcctgggagggacgactgcagatccttttctaccgagttctcgagtgcattttgttctgtaaatttggaagcgtcatgggtgtc

SEQ ID NO: 212 - protein, 314 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 213 - protein, 340 aa, Ricinus communis
MGEEANHNNNNNNINSNDEKNEEKSNYTVVNSRELYPTNIFHALLALSIWIGSIHFNLFLLFISYLFLSFPTFLLIVGFFVVLMFIPIDEHSKLGRRLCRYVCRHACSHFPVTLHVEDMNAFHSDRAYVFGYEPHSVFPLGVSVLSDHFAVLPLPKMKVLASNAVFRTPVLRHIWTWCGLTSATKKNFTALLASGYSCIVIPGGVQETFYMKHGSEIAFLKARRGFVRVAMEMGKPLVPVFCFGQSNVYKWWKPDGELFMKIARAIKFSPIVFWGVLGSHLPLQRPMHVVVGKPIEVKQNPQPTVEEVSEVQGQFVAALKDLFERHKARVGYADLTLEIL

SEQ ID NO: 214 - protein, 322 aa, Vernicia fordii
MGMVEVKNEEEVTIFKSGEIYPTNIFQSVLALAIWLGSFHFILFLVSSSIFLPFSKFLLVIGLLLFFMVIPINDRSKLGQCLFSYISRHVCSYFPITLHVEDINAFRSDRAYVFGYEPHSVFPIGVMILSLGLIPLPNIKFLASSAVFYTPFLRHIWSWCGLTPATRKNFVSLLSSGYSCILVPGGVQETFYMKQDSEIAFLKARRGFIRIAMQTGTPLVPVFCFGQMHTFKWWKPDGELFMKIARAIKFTPTIFWGVLGTPLPFKNPMHVVVGRPIEVKQNPQPTAEEVAEVQREFIASLKNLFERHKARVGYSDLKLEIF

SEQ ID NO: 215 - protein, 355 aa, Mortierella ramanniana
MASKDQHLQQKVKHTLEAIPSPRYAPLRVPLRRRLQTLAVLLWCSMMSICMFIFFFLCSIPVLLWFPIILYLTWILVWDKAPENGGRPIRWLRNAAWWKLFAGYFPAHVIKEADLDPSKNYIFGYHPHGIISMGSFCTFSTNATGFDDLFPGIRPSLLTLTSNFNIPLYRDYLMACGLCSVSKTSCQNILTKGGPGRSIAIVVGGASESLNARPGVMDLVLKRRFGFIKIAVQTGASLVPTISFGENELYEQIESNENSKLHRWQKKIQHALGFTMPLFHGRGVFNYDFGLLPHRHPIYTIVGKPIPVPSIKYGQTKDEIIRELHDSYMHAVQDLYDRYKDIYAKDRVKELEFVE

SEQ ID NO: 216 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 217 - protein, 328 aa, Homo sapiens
MAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 218 - protein, 361 aa, Bos taurus
MKTLIAAYSGVLRGTGSSILSALQDLFSVTWLNRAKVEKQLQVISVLQWVLSFLVLGVACSVILMYTFCTDCWLIAVLYFTWLVFDWNTPKKGGRRSQWVRNWAVWRYFRDYFPIQLVKTHNLLTSRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLRNRKGFVKLALRHGADLVPTYSFGENEVYKQVIFEEGSWGRWVQKKFQKYIGFAPCIFHGRGLFSSDTWGLVPYSKPITTVVGEPITIPRLERPTQQDIDLYHAMYVQALVKLFDQHKTKFGLPETEVLEVN

SEQ ID NO: 219 - protein, 388 aa, Mus musculus
MKTLIAAYSGVLRGERRAEAARSENKNKGSALSREGSGRWGTGSSILSALQDIFSVTWLNRSKVEKQLQVISVLQWVLSFLVLGVACSVILMYTFCTDCWLIAVLYFTWLAFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLKNRKGFVKLALRHGADLVPTYSFGENEVYKQVIFEEGSWGRWVQKKFQKYIGFAPCIFHGRGLFSSDTWGLVPYSKPITTVVGEPITVPKLEHPTQKDIDLYHAMYMEALVKLFDNHKTKFGLPETEVLEVN

SEQ ID NO: 220 - protein, 3 aa, Artificial Sequence
  conserved sequence
YFP

SEQ ID NO: 221 - protein, 4 aa, Artificial Sequence
  conserved sequence
HPHG

SEQ ID NO: 222 - protein, 4 aa, Artificial Sequence
  conserved sequence
EPHS

SEQ ID NO: 223 - protein, 24 aa, Artificial Sequence
  conserved sequence
  misc_feature (2)..(2): any amino acid
  misc_feature (5)..(5): any amino acid
  misc_feature (6)..(6): Lysine (K) or Arginine (R)
  misc_feature (7)..(7): any amino acid
  misc_feature (9)..(11): any amino acid
  misc_feature (13)..(15): any amino acid
  misc_feature (16)..(16): Leucine (L) or Valine (V)
  misc_feature (19)..(21): any amino acid
  misc_feature (24)..(24): Glutamic Acid (E) or Glutamine (Q)
RXGFXXXAXXXGXXXXVPXXXFGX

SEQ ID NO: 224 - protein, 8 aa, Artificial Sequence
  conserved sequence
  misc_feature (3)..(3): any amino acid
  misc_feature (5)..(7): any amino acid
FLXLXXXN

SEQ ID NO: 225 - protein, 118 aa, Artificial Sequence
  conserved sequence
ALVVANHQSFLDPLVLSALLPRKGGRVRFVAKKELFYVPLLGWLLRLLGAIFIDRENGRLARAALREAVRLLRDGGWLLIFPEGTRSRPGKLLPFKKGAARLALEAGVPIVPVAIRGT

SEQ ID NO: 226 - protein, 187 aa, Artificial Sequence
  conserved sequence
  misc_feature (15)..(15): any amino acid
  misc_feature (18)..(18): any amino acid
  misc_feature (23)..(23): any amino acid
  misc_feature (25)..(26): any amino acid
  misc_feature (28)..(30): any amino acid
  misc_feature (32)..(33): any amino acid
  misc_feature (35)..(38): any amino acid
  misc_feature (41)..(41): any amino acid
  misc_feature (46)..(48): any amino acid
  misc_feature (53)..(53): any amino acid
  misc_feature (55)..(57): any amino acid
  misc_feature (61)..(61): any amino acid
  misc_feature (67)..(67): any amino acid
  misc_feature (72)..(72): any amino acid
  misc_feature (74)..(77): any amino acid
  misc_feature (79)..(79): any amino acid
  misc_feature (114)..(114): any amino acid
  misc_feature (127)..(128): any amino acid
  misc_feature (136)..(136): any amino acid
  misc_feature (139)..(142): any amino acid
  misc_feature (144)..(144): any amino acid
  misc_feature (150)..(150): any amino acid
  misc_feature (164)..(165): any amino acid
  misc_feature (167)..(172): any amino acid
AVFDKDGTLTEDDTXFLXYLLKXLXXLXXXLXXDXXXXGSXLTLSXXXDLLEXLXXXGGIXVIGLAXRYLEXLXXXXEXAKLFEGFIKPDAAELLKELHEAGLRVVVLTGDPRXIAKPVAKELGIDXXNVLATELXDEXXXXVXGRITGXLDKARAVERLVVLXXKXXXXXXVVAIGDSANDLPALK

SEQ ID NO: 227 - protein, 190 aa, Artificial Sequence
  conserved sequence
IKAVVFDKDGTLTDGEPPIAEAIVEAAAELGLPLLLPLEEVEKLLGRGVEGIERILLEGGLTAELLLELEGELAAGKTAVLVALDGEVLGLIALADKLYPGAREALKALKERGIKVAILTNGDRANAEAVLEALGLADLFDVIVDSDDVGPVKPKPEIFLKALERLGVKPEEVLMVGDGVNDAPALAAAG

SEQ ID NO: 228 - protein, 15 aa, Artificial Sequence
  conserved sequence
GDLVICPEGTTCREP

SEQ ID NO: 229 - protein, 6 aa, Artificial Sequence
  conserved sequence
  misc_feature (2)..(2): any amino acid
  misc_feature (4)..(4): any amino acid
  misc_feature (5)..(5): Threonine (T) or Valine (V)
  misc_feature (6)..(6): Leucine (L) or Valine (V)
DXDXXX

SEQ ID NO: 230 - protein, 24 aa, Artificial Sequence
  conserved sequence
  misc_feature (2)..(18): any amino acid
  misc_feature (19)..(19): Glycine (G) or Serine (S)
  misc_feature (20)..(20): Aspartic Acid (D) or Serine (S)
  misc_feature (21)..(23): any amino acid
  misc_feature (24)..(24): Aspartic Acid (D) or Asparagine (N)
KXXXXXXXXXXXXXXXXXXXXXXX

SEQ ID NO: 231 - protein, 25 aa, Artificial Sequence
  conserved sequence
  misc_feature (2)..(19): any amino acid
  misc_feature (20)..(20): Glycine (G) or Serine (S)
  misc_feature (21)..(21): Aspartic Acid (D) or Serine (S)
  misc_feature (22)..(24): any amino acid
  misc_feature (25)..(25): Aspartic Acid (D) or Asparagine (N)
KXXXXXXXXXXXXXXXXXXXXXXXX

SEQ ID NO: 232 - protein, 26 aa, Artificial Sequence
  conserved sequence
  misc_feature (2)..(20): any amino acid
  misc_feature (21)..(21): Glycine (G) or Serine (S)
  misc_feature (22)..(22): Aspartic Acid (D) or Serine (S)
  misc_feature (23)..(25): any amino acid
  misc_feature (26)..(26): Aspartic Acid (D) or Asparagine (N)
KXXXXXXXXXXXXXXXXXXXXXXXXX

SEQ ID NO: 233 - protein, 27 aa, Artificial Sequence
  conserved sequence
  misc_feature (2)..(21): any amino acid
  misc_feature (22)..(22): Glycine (G) or Serine (S)
  misc_feature (23)..(23): Aspartic Acid (D) or Serine (S)
  misc_feature (24)..(26): any amino acid
  misc_feature (27)..(27): Aspartic Acid (D) or Asparagine (N)
KXXXXXXXXXXXXXXXXXXXXXXXXXX

The invention claimed is:

1. A method of producing extracted lipid, the method comprising the steps of:

a) selecting a vegetative part of a plant or a unicellular plant
   i) expressing an exogenous monoacylglycerol acyltransferase (MGAT); and
   ii) comprising a level of triacylglycerol (TAG) that is greater on a relative basis when compared to such a vegetative part of a plant or unicellular plant lacking the exogenous MGAT, and
b) extracting lipid from the plant, thereby producing the extracted lipid.

2. The method of claim 1, wherein the level of TAG in the vegetative part of the plant or unicellular plant is at least 10% greater on a relative basis when compared to such a vegetative part of a plant or unicellular plant lacking the exogenous MGAT.

3. The method of claim 2, wherein the level of TAG in the vegetative part of the plant or unicellular plant is at least 30% greater on a relative basis when compared to such a vegetative part of a plant or unicellular plant lacking the exogenous MGAT.

4. The method of claim 3, wherein the level of TAG in the vegetative part of the plant or unicellular plant is at least 90% greater on a relative basis when compared to such a vegetative part of a plant or unicellular plant lacking the exogenous MGAT.

5. The method of claim 1, wherein the plant is *Brassica* sp., *Gossypium hirsutum*, *Linum usitatissimum*, *Helianthus* sp., *Carthamus tinctorius*, *Glycine max*, *Zea mays*, *Arabidopsis thaliana*, *Sorghum bicolor*, *Sorghum vulgare*, *Avena sativa*, *Trifolium* sp., *Camelina sativa*, *Miscanthus×giganteus*, or *Miscanthus sinensis*.

6. The method of claim 1, wherein the plant is an aquatic plant.

7. The method of claim 1, wherein the plant is a unicellular plant.

8. The method of claim 1, wherein a vegetative part of a plant is selected.

9. The method of claim 8, wherein the TAG, diacylglycerol (DAG), TAG and DAG, or monoacylglycerol (MAG) content of the vegetative part of the plant is at least 10% greater on a relative basis than the TAG, DAG, TAG and DAG, or MAG content of a corresponding vegetative part of a plant lacking the exogenous MGAT.

10. The method of claim 1, wherein at least 60% (mol %) of the fatty acid content of the extracted lipid is oleic acid.

11. The method of claim 1, wherein the polyunsaturated fatty acid content of the extracted lipid is increased when compared to the polyunsaturated fatty acid content of a plant lacking the exogenous MGAT.

12. The method of claim 1, wherein the method further comprises determining the level of TAG in the extracted lipid by analysis, wherein the analysis comprises gas chromatography of fatty acid methyl esters obtained from the extracted lipid.

13. The method of claim 1, wherein the plant is other than a unicellular plant, and extracting lipid from the plant is extracting lipid from a part of the plant.

14. The method of claim 8, wherein the method further comprises harvesting seed from the plant.

15. The method of claim 8, wherein the plant comprises seed, and step b) comprises pressing seedoil from seed.

16. The method of claim 1 which further comprises reacting the extracted lipid with an alcohol, optionally in the presence of a catalyst, to produce alkyl esters.

17. The method of claim 16 which further comprises blending the alkyl esters with petroleum based fuel.

18. The method of claim 1, wherein the plant or vegetative part of the plant or unicellular plant further comprises an exogenous glycerol-3-phosphate acyltransferase (GPAT).

19. The method of claim 18, wherein the exogenous GPAT has phosphatase activity to produce MAG.

20. The method of claim 19, wherein the level of TAG in the vegetative part of the plant or unicellular plant is at least 10% greater on a relative basis when compared to such a vegetative part of a plant or unicellular plant lacking the exogenous MGAT.

* * * * *